United States Patent 12,746,261 (PROBIOTIC BACILLUS COMPOSITIONS AND METHODS OF USE) - sequence listing, part 15

SEQ ID NO: 262 - DNA, 3968902 bp, Bacillus amyloliquefaciens (residues 1-1,984,451 of 3,968,902)
tttggactgaatgaaatatttaattcctcgccgtcaatctggtcagccagcacagcttcgaccactttcccgatttccggagaatttgatgaaatctccagcgaatccgccggtttggcagaaagctttacaacgttgttgcggccttctctcgccaataaagaagcacggtctatcgcctgtaaaaattccttcgtgttcacgacgatttccgttttgctttcctgcggaattaagctggtcgtgtccggatagtttccgtcaagcaatcttgagaagaacaatacgtttttcgctttgaacagaacttgggtttctgtaatgacgatatcaaccagttcttggttgtcatcaagaattttgctcagctcggttaagcttttcccaggaatgaccacgttataagagctgtcttccggaatatcaagcttcgcctttcttaaagcgagtcggtggctatccgtggcagtgcataataattcaccgttttcgactttccagtttacacctgtcaagatagggcgtgtttctgaggcggacacagcgaacacggtttggcgaatcaggtttttcaaaagatccgtcggaatctgaatggcgtgatgctcttcgatttgcggcagatgcggatattcatctgcatcaaggccgtttaaattaaattcggcttttccggaacggataatcgttaaatattgattttgaacttcgatttcaacagtcgccatcggaagttttttaacgatttcgctgaagaaacgggcttgcagcacgatacttcccggctgatcgatcgtcacgatttctttatcatcttcttctttcggaatgaatgactcgattgaaatatcagagtcacttcctgtgaaagatactccttcatctgaggcgacgatcttaataccggtgagaatgggaattgtggttctggatgaaacggcttttagaacgtcttgtacactttcgactaaacgatctttttgaatcgtaaatttcatgtttatcctcctaacggataatataattaatatattttaaaaatagcagtagtaatagtagggcctgtggatttgtggataagttgtgaaaaagacaggaaacacagcctatccacatgtggacagactgtgtatggctatgaaaaagttattcacactttccccgattcatccgagggcactattatttaagcagttcttttatttctttcacctgctgctgaagctgctcgtcatcaatcagcagttttgaaatcttttcatgggcgtgaatgacggttgtatggtctctgccgccaaattcttccccgattttaggcaaagaagaatccgtcatttctcttgaaagatacatcgcaatttgtcttgggaacgccacggatttcgtgcgctttttcgctttgaaatcttcaagcttaatgttgaactgctgtccgacaatccgctgaatctcttttatcgtaatgaccttcggcttagaagacggaatgatatctttcaatgcttctgcagccaggtctgcgttaatgtctttattgattaaggatgaataggcgacaacccggattaatgccccttccagttcgcggatgttgctgtcaatctgattcgcgatgtaaagcatgacctcgttcggaatatcaagaccttccgccttcgctttttttctcaggatggcaatccgcgtttccagatccggcggtgtgatatccgtaatcaatccccattcgaaccgcgaacgcaggcggtcttcaagggttgggatctctttcggcggtctgtcgctggaaatcacgatttgtttgctttcttcatgaagcgtgttgaatgtatggaaaaactcttcctgtgtttgttcttttccggctaaaaattgaatatcatctatcaaaagtacatcaacgttccggtagcgattgcggaaatcaacggctttattatcgcggattgagttgatgaattcatttgtgaatttttcagaagacaggtacaccactttggctgaaggattatgatcaatgacataatggccgatcgcgtgcattaagtgggtttttcctaagccgactcccccgtatataaataaagggttgtacgctttagcgggtgcttccgccacagccagtgatgctgcatgggcgaatcggtttcccgatccgatgacgaatgtgtcgaatgtatatttcgggttgagcatgctttggggaaaatcagacggttcctcttttgccgcttttttcacttgcggtttcggtaaaaagttttcttcgtcctgattttgaggaatgacaaatttgacgctcaattcttccccggttaattcgtatatggtatctgcaatgagatgtaagtacctggactccagccagtctcgggcaaattcattgggagcggtgatggttaaggtatccccttgcagcgaatgggctttcgtcgacttcatccaagtttcgaaactcggtttgcttagctttttctcaatttgagctagagcttgattccaaagatccaatatattctccattatccggcacagccctccttttctttaaaaatcagcgccctttccctgttatagaacacaaaaaaagagcatatggctctgaccattcgtacacacgaaatgttgaaaacatatagtatagtagaaaaacagcttttcgacaaattccacaagttgtggacaacaatctacacaagctgtgtgaaaacaatccacaacttatccacagtttgtggataaagagaatgggctggataagtaattaagagttaaaacacaaatataatatcaaattaagcgaggacttgcaatggttctcgtaatcttatccacaaacctgacaacttgttgaaaaatctttgtccacatgggttagcaatgtgaaaatgttgtcgataacgactgtggatattaaaaaaaggccaaaaaattatccacatgtcgtttttccgggggagcgcggcttttttttttgcgttaaaaaaaggaatatgaaaaataaggtttctaaactggttaaggtatgttatcctattatggttgtaagaaataaaagcactgctgaagttgacaatgaataggcagcacaaatataataagtaagactgtctttaacagctattcctcgagggaggtgtcataaatgaaaagaacattccaaccgaataaccgtaaacgcagtaaagttcatggcttcagaagccgtatgagttcaaaaaacggtcgtctagtattagcacgccgtcgccgcaaaggcagaaaagtattatcagcttaggccactgaataatgtcagtggtcttttttcacattaagagagtgagatgtcatgcgtcgcccggtactggagaaatttcttcagtattccggcggcccgttttttttagatagaaataaaagtttctgcgagtgaatatcggagtgaattaaagtgaagaagcgaaatcggttaaagaaaaatgaagattttcaaaaagtgtttaaacgcggaacgtctatggcaaaccgccagttcgtgctgtatacgcttgatcagccgaaacaggaagagctccgggtagggctttctgtcagtaaaaaaatcggcaatgccgtcgtgcgcaatcgggtgaagcggttaatcagacaggctgttcaggaggaaaaagagctgctcaagccgaaagattttattattatcgcaagaaaacccgccggcgacctcagttttgaagaaacgaaaaagagtctgcagcacttattcagaaaaacctcattatataagaaatcttcgtcaaaatagctcatattttgttttcttcacgtttttaaaagcgcttccttttatttggcgaaaaatgaacgccatttgaaactgaaagatgctaaaatacatacaaggttcataaagattggtataggaggaaacgttcttgaaaaggagaatatggttactactgagtatggtcggtatgctcgtgctgctggccgggtgctcgagtgtgaaagagccgattacggcgaatagtccgcatttctgggacaaatatgttgtgtatccattgtcagaagttattacgtacgtagcgaaactgacgggcgataactatggtttatcgatcatcatcgttacgattttaattcgtctgctgattctgccgctgatgatcaagcagcttcgaagctcaaaagcgatgcaggcgctgcagcctgaaatgcagaagctcagagaaaaatacagctctaaagatcaaaaaacgcagcagaagcttcagcaggaaacgatggccctgttttcaaagcacggggtaaacccgctggcgggatgtttcccgatcctgattcaaatgccgattttgatcggattctaccacgccattatgcgtacgcaagccatatcacagcacagctttttatggtttgatttaggagagaaggatccttactatattcttcctatcgttgccggtgtggccacttttgtccagcagaagctgatgatggccggaaatccgactcagaatcctcaaatggcaatgatggtatggattatgccgatcatgatcatcgtatttgcgatcaacttcccgagcgcgctttctctgtattgggtagtcggaaacctgtttatgattgctcagacattccttattaaaggacctgacattaaacacgatccggaaacgcagaaagcgggaggaaagaaaaagtgaagaaggtgactgctgcgggacggaatgtcgaagaagcagttcaatcaggccttcaggaacttcaactgacgaaagatcaagtagaaataacggtggtgcaagaagaatacaaagggtttttgggtattttcggaaaaaagaatgcgatcgtagaactggaagagaaaaaaaatcctgttcatgaagcgaaagtgtatttggaagaaatcatccattccattgccggaccttctgagattgttacggaagaaaacaagaaaacagtctgttttcacattaaaggtgaaaaagcggcgctgcttattggcaaaagaggacaaacactcaatgccctggaaacattgacgcagcttgttttgaaccgcggctccggccagtatcgccaagccgttgtcgacgctgagaattatcggcggaaaagaagagaaattctggagcagctggcaaacaggctggccaagcaagtgtcgaaaacgaaaaaagatgtgcatttagaaccgatgccgtcaggtgaaagaaaaatcatccatgacgcgctgtcaaagcatccaaatatcaaaacgttttctaccggtgaaggccggtaccgccatctcgttatttcccataaagatagcagaaaaccgaagtccgggtaaaatcggaacttcggtttttttattggtaaaaatggctctattcctaagcagaatcgcactttttgcgtttaagttttttctttttcggtctatgctgttgataaaaaaggttttaggaaataaaattaattgttattcacatgtggataagttaaagtaataagggatgaatttctgcctttgtggataacgtatcttccacttcaaaccaaactatgttatcttttaattttggcgtaaataaaattttttatatagatggaaacagagataaagagaggtgaacagcatggatacaattgcagcgatttcaactccgatgggtgaaggcgcgattgcgatcgttcggctgagcggccctgaagccgtaaagatcgccgacaaaatgtacaagggtccgaaaggcaaaacgctcagttcggcagaatcgcataccattcattacgggcatatcgcggacagcacgacgggacggattattgaggaagtcatggtgtctgttttaagagcgcccagaacattcacaagggaagatgtcattgaaatcaactgtcatgggggtattgtgacggttaatcaggtgctccagcttgctttaagagaaggtgcgagactggcagaacccggtgagtttacgaagcgcgcatttttaaacggacggattgacctttcacaggcggaagcggtgatggatctgatcagggccaaaacggaccgtgccatgaatgtcgccatgaaccagatggaaggacggctttccgcgcttgtccgccgtctgcgtgatgagttgttagaaacacttgcccatgttgaggttaatatagattatccggaatatgatgacgtcgaagaaatgacgcatcagcttttagtggagaaggcaagcggcgtgaagaaagaaatcgaggcgctgctccgtacgtctgagcaggggaaaattttgcgtgagggactgtctaccgtgatcatcggccgtccgaacgtcggaaaatcctctctgcttaacagccttgtccatgaaacgaaggcgatcgtaactgatattccgggaacgacgcgtgatgtgattgaggaatatgtcaatgtccgaggcgtgccgcttcggcttgtcgataccgccggaatccgtgagacagaagacatcgtcgaaagaatcggtgtggaacggtcacggcaggttctgaaggaagcggatctcattttgcttgtgcttaaccacagcgaagagctttctgaagaagatgtgaaattgtttgaagcggttgagggaatggatgtcattgtcactatgaataagacggaccttgaggctaagattgacgctgagcgcgtcaaggaactggcgaaaggccggcctgtcgtcacgacctcattgctgaaagaagaaggcattcaagatttagaggaagcgattcagtcgctattttatacaggagcgatcgaaagcggagatctcacctatgtcagcaacacccgtcatatctcgattctgcatcaggcaaagcaagcgattgatgatgcgctgaacggaattgaacaggatgttccgattgatatggtgcaaattgatttgacaaggtgctgggagctgctgggcgaaatcatcggtgatgccgtccacgaaagcttaattgatcagctcttttcacaattttgtttaggtaaataaaagggaggaaaaaaccatggggtatgaagcaggccaatacgacgtgattgtcatcggcgccgggcatgccggtgttgaggctgccctcgcatccgcgcgccagggagccaaaacgcttgttttgacgatcaatcttgatatggttgcgtttatgccatgtaatccgtctgtcggcggccccgcgaaagggattgtcgtccgcgaaattgacgcgctcggcggagaaatggctagaaatatagataaaactcatattcaaatgagaatgctgaatacaggaaaaggtccggccgtacgggcgctgcgtgcgcaggcggataaattccaatatcagcacgaaatgaagcatacgctggaaaaaacaccgaatttgacacttcttcaagggattgccgagcgtttaatcattgaagacggggagtgccgcggtgtcattacgcaaaccggtgctgaatataaggcaaaaacggtcgtgctgacaaccggaacgtatttaagagggcggatcattctcggtgatctgtcttactcaagcggtccgaataaccagcagccgtctattaaactttctgagcacttagaggagctcggttttgatctcgtccgttttaaaacgggcacgcctcctcgtgtctcaagcgattccattgattacagcaaaacagaaatccagccgggggacccggttccgcgcgctttctcatatgaaacggttgaatacattaccgatcagctgccttgctggctgacttacacgagtcctgagactcatgagatcatcgacagcaacctgcatcgttcgccaatgtattccggtatgattaaaggaacgggaccgagatactgcccttcgattgaagataaagtcgttcggtttaatgataaaccgcgtcatcagattttccttgagccggaaggcagaaatacgcaggaagtatacgttcaaggtttatccacgagtcttcctgaggacgtgcagcagcggatgctggcgaccattccgggactggaaaaggtgcagatgatgagagccggatacgcgattgagtatgacgcgattgtaccgacgcagctctggcctacactggagacgaaaaaaatccctaacctgtacacggccggtcaaattaacggtacatcaggttatgaggaagcagccgggcaaggaattatggcagggatcaacgcaggccgcaaagcgcttggaaaagaagaagtgatcctcagccgttccgatgcttatatcggtgtattgattgatgatttggtaacgaaaggaaccaatgaaccgtaccgtctgctgacttcacgggcggaatacagactgctgctccgtcacgacaacgcggatcttcgtctgacggaaatcggccacgatatcggcttaatttctgatgagcgctatgaagcgtttgagaagaaaaaagcggcgatcgaggcggagaaaaaacgtctctggtctgttattatcaagccgtctcctgagaatcaggaatatatccgttcactcggcggaagcgagctgaaagacggagtgcgcggcacagatttaatgaaacgtccggaaatgaactatgaaacagtgacaaaacttgcgcctgcagattctccggttccgcaagatgtggcggaacaagtggaaattcaggtgaaatatgaaggatatatcgaaaaatccttgcagcaagtggaaaagctgaagaaaatggaaaacaaaaaaatccctgatcggattgattatgacgccattaaaggaattgctactgaagcccgtcaaaagctgaaagaagtgcgtcctttatcagttgctcaagcgtcccgtatttccggcgtcaatccggcagacatttcaatcctgctggtatacctggagcagggccgtattgccaaggtagctgaatagaaaggatgacggcatgaatatagaggaatttacatccagtttagcggagaaagggatttccctttctgaccgccagctggagcaattcgagttgtattaccggatgctcgtggaatggaacgaaaaaatgaatctgacatccatcactgagaaaaaggaagtttatctcaagcatttttatgattcgataacggcggcattttatattgattttgaaaaggttaccactctttgtgatgtcggcgccggcgccggttttccaagcctgcccatcaaaatctgcttcccgcatctgcatgtcaccatcgtcgattcactgaataagcggattacgtttttggaaactctctctgatgctttacaattagagcatacgacatttgtccatgacagagcggagacattcggacaacggaaagacgtacgggaaagcttcgatctcgtgacggcccgtgcggtggcgcgtctgtcggtcctgagtgagctttgtctgccgctggccaagaaaaacggcgtatttgcggcactaaaagcagcagcagctgatgaagagctgaaagcggggcaaaaggcgattaaagtattgggaggagagcttgaacaagttcattcctttacacttcctgttgaagaaagtgaacggaacatcatgatcattcgcaagacgaaaagcactccgaaaaaatatccgagaaaaccgggtactccaaataaatcgccaattgaagggtaatttagacagcctgatgtgacaattccatcatattttctgcaaaattgatgaagatacagcaggaaaaaccatgagaaaatagaattataaaaatggcagtttttaaaggtggtgtaggtacatgaagcattcattctctcgtttcttcgggtttggtgagaaggaagaggaaccggagatagctgagcatgatacaaacaaagaagagatactcgaaataccggtacatgctatcgttcccaaccgttttcagccacgcaccattttctcagatgaaaaaatcaaagagttagcaatgactatccatacacacggcatcattcagccgattgttgtcagacatacagaagatgaaggacaatatgagctcattgcgggtgaaaggcgctggagagcggtacagacgcttgaatgggagaagattcccgcaattattaaagatttttctgatacggaaacagcatctgtcgctttgattgaaaacctgcaaagggaagaattgtcctccattgaggaagctcatgcgtacgcaaggctgttagaacttcatgatttaacacaggaagccttggcgcagcgcttaggaaaaggccagtcaacgattgcgaacaagctccgattgttaaagctcccggaacccgtccaggatgcgattatggagaaaaaaattacggaacgtcatgcaagagcactgattccgctcaaacagccggagtttcaggtcacattgcttgcggaaatcattgagaaaagcttaaacgttaagcagacggaagacagagtggtgaaaatgcttgaacagaataagcagaaaccaaagccgagacgcaaagcgttcagcagggatacaagaattgcgatgaatacgattcgtcagtcactgtctatggtagaagacagcggcgtcaggctgaacactgaagaagaagaattcgaagagtacatccagcttaccattcggatacctaaataaaaactctcctgatcagcaggggagtttttattttaatcaaaaaactattttgagataatgatagatttattgtgcactatacattatttatgtaaaattttatctttttgtgtcgtgaattgtctttttacagtcaaaaaagtcactttatcggagaacttatattagaaagtgtctttttcgtttacatttttttcacttgctgataaacaaattatgaaaaaaataaaacgctttactctttttttgataagatagaaacaagacagtacatgttcatgtgaaggtaggtgacatcgtgggaaaaatcatagcaattacgaaccaaaaaggcggagtcgggaagacgacgacttctgttaatctgggggcttgcttggcttacataggtaaaagggttcttcttgttgatattgatccgcagggcaatgcaacgagcggattagggattgaaaaagccgatgtggatcattgtgtgtacgacattttagtagatgatgcagatgttacagatattattaaaccgacttcagtagagaacttagatgtcattccggccacgatccagcttgcgggagcggaaatcgaattggttccgacgatctcacgggaggtcaggctgaaaagagcattagaatcagtgaaacaaaattacgattacatgattattgattgtcctccgtctctcgggttattaacgattaatgcgcttaccgcttcagattcagtcgttatcccggttcagtgcgaatactacgctcttgaaggattgagtcaattattaaatacagttcggcttgtgcaaaaacatttaaataccgacttaatgatagaaggagtgcttctgacgatgcttgatgccagaacgaatctcggcattcaagtgatagaagaggtaaagaaatactttagagataaagtgtatcaaaccattattcctcgaaatgtccgtttaagtgaggcgccgagtcacggcaagccgatcatattatacgatccgcgttcgagaggtgcggaagtatatttagatttagcaaaggaagtggcagcgaatggctaaaggcgggctcggaaaagggattaacgcgttgtttaatcaggttgatttgtctgaagagacagtggaagagattaaaatcagtgatttgcgccccaatccttatcagccaagaaaacaatttgacgatgagtcattagctgaactgaaggaatccatcattcagcatggcattcttcagcccattatcgtgagaaaatcattgaagggctatgatattgtagccggcgaacgccgttatcgcgccgcaaaacttgccggtaaagagacagtgccggctatcgtgcgggatttatctgaatcgctgatgcgggaaatcgctcttttggaaaaccttcagcgtgaagacttatcaccgcttgaagaagctctggcatatgactcactgctgaagcatttggatttaacccaggaacagctcgctaaacggctcggaaaaagcaggcctcatattgccaaccatttaagactgctgacgctgccggaaagcatccagaacctcattgcagaaggtacgttatccatgggacacggcagaaccttgcttggtttgaaaaataaaaacaagcttgaaccgcttgtgaagaaagtggttgaagaacagctgaacgtccgtcagcttgagcagctgattcagcagttaaacaacaatgttccacgtgaaacaaagaaaaaagaacctgtccaagatgtggtgttaaaagagcgggaatcgtatttgcaaaattacttcggaacaacagtaaatattaagagacaaaagaaaaaagggaagattgagattgagtttttctcaaatgaagatcttgaacgtatcctagaactattgtctgaaagagaagcgtaaaaaccatctttttaaaaaaagatggttttttatatacgtcttgtcagcttatgaaatggactgagccgttcctgccggccttctgatttatctgtcagctgtaacccctctgctaaaacatttgccatgctcataacaagatgaagcctcgtattctgcaggacaaaatactccataaacccgctgacattgacgattccattgatatggacgtcaccgatttcaggaagatctttttgaacacctgctccgggcttcagcggcccatcgccgatttgaaatgaccctacgcttttgacgcggcctaaacaagcatcaaccgctataataaacggatttttatgtagatgttgaatatctttcagcttgtctttcatattgacggcgtgaacaggatctgacagcgtgccgtaaacgtgcaatctgcctaaattcattttttctaactttgttcctacgagcggacctaatgaatctccggtcgaccgatctgtgccgatacacacggtgactaacggtctgccggctgctttacgtaaagatgaagtaaggatcgcttgtatttgattcgcagcagaagaatccgtatgagatacatattgttttgcccgttcttgagaaaaaagcccgccttttcgattcataaggttcacttccttgtcatgtcatacgagtattacattgttgtttttggtgatgtatggttgtttacagtatatccagcgctgcctttttttatgcttatgtcatgatcagcatgccggttgtttgaaaagagcgggatagaaaaaagaacccagagcagttattctctaagttcatgaaagaaataagaccatttgatctacatcaacatattgctgatgatctaatttcagcgctcttttttctgtagagaagaggataaatcctaactgagcgtagagttttattgcgggttcatttgttgaggtaacagagagatggagctgttctgtgtccttcatcttttttgctcggctgatggcttccgtcattaacgcttttcccgcgcctgaccctcggtgtttgggggaaatatacatagaaccgataaccgcaatgtgtcttagtttaaacagcggatgcttggagatcttgaggattcctatcagtctgtctttttcaaaggcgccaagcacgatggcattgtcggcttcaagcctggctttaaatttttcggacggccattctttctcctcatcatagctgacggcaaatgcgtccgggtgatcttttaaagctttgagcctgatatcggtataaggctgggtatcatttgcggttaaacgcctgatgtacatggtttgagctccttgcataagtgaatttttctgaatagtcaatcgtcgatatcataccatatttgtcccatttgtatgaatgattgccgctgtcactcaatatagtagcaatatgcggagatgatcagaaattttatgaggtgatgagggtgtggagagccgggatgaagtggatgctgctcatattaagcagccagattggggctgggtatgcaagcgggcaggaaatatggcagtttttcggtgtcgaaagcggactggctattgtattgtttacagtcatgtttacgatttcggcttatattgtgttgaagatcagctatcgggttcaatcaacgcactttttacctgtgcttgagcatctgatggggccggctcttgctaaagtctatgatgtgcttattatgttttatttgttttcaatgacgatggttatgattgccggcggcggtgtgacgctgcaaatgtacaagctgccgttttggatcggtatttttcttctttgcattgtgaccgtcggtttattcttttgggatataaaaggaatattatctctgaatagtattttgataccgattcttgtagcggggctgttatatgcattggtcttttttcagacaacccatcattacacgtggacgatagatttgacccgccagtataattggccggcaagcattaccttcacgtctttaaacatcctttctgttgtcgctgttctttcttcaatcgggaaagatatgaagggactgggagaagcgaaaatcgcaagcgttgcaagcgggctgattttcggtatgatttcatttgtttacaatgaaacgcttgtacagctttcaggcagtcttacacaatatgagattcctcttttcgctgtccttgaaggcgctccttatccgttatttctttgtatggccgccgtgctttttttagccatctatacgacaaccgtgaccggtctgttcgggctgtccagccgcatgcttgcatttgtgaaattgccgagatggacgctcgtatctcttcttttagctgtgatggtgccttttacgacaatcggtttttcagatttgatcgccattttatatcccatttacgggcttttaagtctttatttgctggtatgtcttcttctttaccctattttagggagatggaaaaaagtataatgctcattttgagtgcggccgttgctcttatcctgtttttttttgtacaataaataaagcagtctatggagagaggtgaagggtcttggcggataaagactttggcctgaatgatattgttgaaatgaagaaaccgcatccttgcggtgaaaacaggtggaaaatcattcggatgggaatggatattcggattaaatgcacgggttgttcccacagtgtcatgattccgagaagagattttgagagaaagctgaaaaaagtactcgtcaagcatgaggagcctacatcataagggctggcgctcatgctttttcatatagaggagaggaagaggcccgatgagcaaagtgcatcagtcagcgtgcccgctgaattgctgggacagctgcggctttttggtgacagttgaggatggaaaggtgacgaaagtagacggagacccgaatcatcccattacggaagggaaaatttgcggccgtggcagaatgctggaggcgaaaacgaatgcgccggaacggcttcgttttcctttaaaaaagatagacggcgaatttgtccgcatttcctgggagcaggcgttagatgaaattgctgaaaaaatggcggtgattaaggagacgttgggcactgccgcagtgctgcacagtcatgattacgccaataacggtcttttgaaggcgctcgaccagcgttttttcaatggatacggcggtgtgacggagattgcgggcagcatttgctggggttccggcattgaagcgcagcgctgggatttcgggcgttcttacgggcatggaccgcttgatatttatcacagcaagcatgtgatcgtatggggcagaaacgtgtcccggacgaatatgcacctctatcatcatctgcagcaggtgaagaaaaaaggagcgacactgacggtcattgatcctatttttaacccgactgccaagcttgccgatcggtatatatccgtcaaacccggcatggatggatggcttgcggcgggtgttttaaaaatattatgccaaaccggcagaaccgattccgatttcattcaaaggcattcggtcggttttgaagaaatagaaaagcttctgcagacgatttctattgaggagatcattgagaaaacagaaacgtctttagaagtgcttgaatatcttgctgatttatatgctgacggtcccgcctccacttttatgggtcttgggatgcagagatataaaaacgggggcgggacgatacggtggattgacgctttagctgcggcgagcggaaatgtcggtatcaaaggcggcggcgcaaacttcggaaatgtgcaagtcggtgaaagctttgcaaaggccgagctcacccggcctgatctgaagaaaagttcgagaacgttttcgatgatgactcaagccgaagaggcgctgaatgcagccgatccgccgattgagatgatcatcgtgacgtgcggcaatccgctgacacaggtgccgaatacaaaaaaagtgaaggaagcatttgaaaaaacaccggtcacagtggccattgattcggtcatgaccgatacggcgaagctctgtgactatgtgctgccgacggccgttgttttcgaagaggaagatatttattattccagcatgtatcatcactatgttcaatatggcaagaagcttgcggaaccgcagggagaggcaaaatcagaccgctggatctggacggaactcgcaaagcgtctcggattcggggagctctttgattacagtacggaagatttcttaaaaatggggctctcttctttggagaaagaaggaatcacccttgagcaattaaaggaaaaaggacatatgccgcttccggtcaaacaggttccgtggagtgattttcaatttttaaccccgagcggaaaatttgaattcgtctcgtcactggcagaagagaaaggatacagcggcctccctcaattggaggtgccggaggagtctgtttatcatgacgccggactggccgggaaatatccgtatatgctgctgtccattcacccgcagcgctccaatcattcacagcacgtgccgtttattgaaaagcttcagcagattcaggtggacctgtcgccggatatcgccgaggagctttcacttcaagacggagatacggcagaggtatacaatgaccgcggccgtctgcgcggcagggtgaaaatcatgaagcaggctcacccgaagacggtgaatatagatgaaggcatgtgggcggcattcggaggctccgtcaacatgctcacaaaggattcaaattccgataatggaatgggaagtacgctttttgactgtctggtagcggttaaaaaaggataatctaaggagagagagggcgggaaatgcttttttctcagcttgtcttttcctatgaacctccttataattgctctaggtttacaatacgtttatacgatgatggtttgatatagaggagatgaaagaatggctttaactgctggaattgtcggtttgccgaatgtcggaaaatcgacgttatttaatgcaattacccaggctggtgccgaatcagccaactacccgttctgtacaattgatccgaacgtgggaatcgtggaagtgccggatgaacgtctgcaaaagctgactgaattggtgaacccgaaaaaaacggtgccgactgcgtttgaattcactgatatcgcggggatcgtaaaaggcgcatcaaaaggtgaaggactcggaaataagtttctttctcatatccgtcaggttgatgcgatctgccacgttgtacgcgcattcgctgatgacaatattacgcacgtgtcagggaaagtcgatccgattgacgatattgaaacgatcaatcttgaattgattcttgccgacatggagacagtcgaaaaacgtatcacgcgtgtaagcaagcttgcaaagcaaaaagacaaagaagcggtttttgaatttgacattctgtctaaattaaaagaagctttcgaacaagaaaagcctgcccgttccgttgaatttacggaagaacagcaaaagcttgtgaagcagcttcatttgcttacgtcaaaacccgtgctttatgtagcaaatgtaagcgaggatgaagtggctgatccttcagataatgaatatgttgcgaaaatccgggagtacgccgcgggtgaaaacgccgaagttatcgtcgtctgcgcgaaaattgagtctgaaattgctgaattggaaggcgaagaaaaacaaatgttccttgaggagctcggcatcgaagaatcaggtcttgatcagctgattaaagcgtcatactctcttctcggccttgcgacatactttacggcgggcgaacaggaagtgcgcgcatggacattcagaaaaggcatgaaagctcctgagtgtgcgggtatcatccacactgactttgaacgcggctttatccgcgctgaaacggttgcttatgaagaccttttggcaggcggcggaatgtccggagcgaaagaagccggaaaagtgcgtctggaaggtaaggaatatgtagtccaagacggagatgtcattcatttccgatttaatgtataggacacagttgtaaagggacaagagctttggtataatataaacttgtgagtaatagaattattgctccttgcccattatagggccgcttagaccaaaaggaggtgcaaacagatgaaaaagtacgaagttatgtacattatccgtccgaacattgacgaagagtcaaagaaggcagttatcgagcgtttcaacaacgtattgacttctaacggagcggagatcactggaacaaaagattggggtaaacgtcgtcttgcttacgaaatcaacgatttccgtgacggtttctaccaaatcttaaacgttcagtctgaagctgcagcggttgctgaattcgaccgtttagctaagatcagtgacgatatcattcgccacatcgttgttaaagaagaagaataagcaatttgaaatatataatgttaaaaggtggtctttcatatgcttaaccgagttgtattagtcggaagactgacaaaagacccagagcttcgttatacgccaagcggtgcggctgtcgccacgttcactcttgctgtgaatcgtacattcacgaaccagtccggagaacgtgaagccgatttcattaattgtgtcacttggagaagacaagccgaaaacgttgcaaactttcttaaaaaaggaagccttgccggcgtagacggccgactccagacaagaaattatgaaaaccagcagggacagcgtgtcttcgtgacagaagtccaagctgaaagtgttcaatttcttgagcctaaaaacagcggcggttctggatcaggcggatacaacgaaggaaacagcggcggaggccaatactttggcggaggccaaaatgataatccgttcggcggaaatcagaacaaccagagacgaaatcaagggaacagctttaatgatgatccatttgccaacgacggcaagccgattgacatctcggatgatgatcttccgttctaatagattatcgctatattcataacgagaaaggtgggaaatgacaatggcaggaggacgcagaggcggtcgtgcgaaacgccgtaaggtttgttacttcacttctaacggcattacgcacatcgattacaaagatgtagatcttcttagaaagtttgtttctgagcgtggtaaaattttacctcgccgtgtaactggaacaaacgcgaaataccaacgtaaattgactatcgcgatcaaacgcgcacgtcaaatggctttacttccatacgtaactggcgagtaagccgaaagaaaagagcaagagcctgcgggctcctgctctttttttatatcagtccccctccatcctgccgaaatgtttcacatgaaacatggaagtgcttcttacacctttgttatcttgctcctctattcaaaaacgcgtacttatgcaatgaatttgtttatactgaaaaacagggggtggctgagatggagacagacagaaatatcctgactgatgaaaagtggagcgcaatcatacataatgatgcttcttatgacggggcattttattatgcagtaaaaacgacaggaattttctgccggccttcttgtaaatcgagagttccgaataaagaaaacgtgctggtgtttgatacggctgatgcagcgctcgagaaacattttcgtccctgtaaaaggtgccggccgaacggtcttcgtcttcctgatgaagaatggattgctcaaatcattgaatacattgaacgccattatcacgaatccctgactctgagtgtactggccgaaatgtgtcacggcagcccctatcatttacagcggacatttaaaaaaatcaggggaatatccccgattgcgtatatacagaaaataagattgtcgaaggcggaacaccttttaaagcatactgatatgacagtcatggagatcgctctgactgtcggaattccaaacacagcgcatttcgcgaccctttttaaaaagggaaccgggagttcgcccacagaatacagaaaaacggccaaaatgggacagggaggttcaatatgagtaaagagcctatgatctattggacactcttcacacggaatgattggagcctgtatacagccgccacatctaaggggctttgctttatagggtcaaatcatggaagctttgaagagcttgagcagtgggcaaaaaaatcactgccgcaataccgattggcacgtgatgatgaaaagctggcgccttacacggcagagttgtccgagtacattgaaaatggcagatcagctttttcagtgccggtggatctttacggaacagaatttcagcttgctgtatggaaagcgcttatggacataccgtacggcgagatatactcctattcggatatagcaaaaatgattcagaaaccggcagccgtaagagccgtgggcgctgcgattggaaaaaatccggtattgattacggttccgtgccatcgcgtcatcggaaaaaacgggaaactgaccggattcagaggcggtttagaaatgaaaaagcagctgctggcattagagggcggaaacattgaaacactggaataccggctgagccggacaggagggatcacatgaaactgatgtcttggaatgtaaacggcttgcgtgccgtgatgaaaaagatagatatcaatacttacgttcaggaaacggaagccgatattctatgtctgcaagaaacaaaagtacaggacggacaagtatcattacagcctgaaggatatcacgcctattggaactatgcggtgaaaaaaggctactcaggcacggctgttttttcgaaagaaaagccgctgcacgtgctctatggactggggattgacgaccatgatcaagaaggacgggtgatcacgcttgaatttgagcatgtgtttgtcgtcaactgttatacgccgaatgccaaacgcggattagagcgaattgattaccgtcttcaatgggaagccgattttaaggattatctgcagaagcttgaccggaagaagcccgtgatcttatgcggcgatctgaatgtcgcacacagggagatagacttaaaaaatccgaaagccaaccggaagaacgccggtttctcggagcaggagcgggaagcgttcagcgccctgctgaacgcgggatttaccgactcattccgctatttatatcctgatcgggaaggcgcctattcctggtggtcttacaggacgaacgcacgtgagaaaaacatcggctggcggcttgattacgtcattgtttcagacagactgaagcagcggatcagccaagcggccatttgtgccgatatcatgggttctgaccattgccctgttgaaatgacagtggatttatgatgagatagcagtaagagaaatccactcttgctgcttttttatcactgaaaatggaggagcacatggcaaatataaaagagattgcgaaactggcgaatgtgtcggtggccaccgtatcacgcgtattaaaccgacacccgtacgtatctgaggagaaaaggcgtcttgtgaatcaagtgatgaaggagctggattatacccctaatcgaaccgccattgatctgattcgcggaaagaccaatacaatcggcgtgattttgccgtacagtgaccatccctgctttgacaaaattgtaaacggtatcacgaaggaagcgtttgcccatgattacgtgacaacccttctccccaccaactatgaccccgctatagagatgacatatttcgaactgctgaaaatgaaaaagattgacggactgattgtcacgtcccgcgcgaatgaatgggagaccgccgtgccttacctggaatacggtcccattgtcgcttgtgaatatacacagcatcaagagattccctgcgcttataatgacaggcaggcagcatacagagaaagctttttgtatttgaaaaaccgcgggcatcaagacgttgcttttacatgtgtgcgggaagcggaaaaaagcccgagtacggccgacaaggtaaccgcatataaggcggtcttcggctctcttgatgaaactcgcattctggtcggatgccatgatatggacgacggaaagcgagcgggtgagcacttctggggtctcgacaaggcgccgacggccatctatgcgcacagtgatgacgtggctgccggcttgtaccagtttgcgaaagaacagaaatgggacgcggagatcatcggcgagggaaatctgagcgtcagccgggcattgaatattccatccctggaacttcatttggaacgggtcggaaaggaagcatttttattattttttcacgaagaaacggctaaaaaacaaattatgcatcaatttcagcggaaaaaagtcttgagctgaaatgggtttcatgctttataaatagattgagaaaaaaagggaggcggacatatgcgaattgaacatgcagcgatatgggtgaaagatttggaacggatgaaagagttttatgagacatacttcggcgccaagaccaatgacctttatcataatgagaaaaaagatttcaaatcgtattttctttcatttgactccggatgcaggctggaacttatgaaaaaaggcggcattgatgaagctccggcacagaatatgaccggatgggcgcatctcgcattttctacaggcagcaaggagcgggtgaatgaattgacggaaacgtttaaaaacgatggatttcaggttgtaagcggcccgcgcgtgacgggtgacggatattatgagagcgtgatagaggatggggaaggcaatttgatagaaatcacagtgtaacagtgcggagtgattccgcactgtttttttgattaaatttgctgtgcatttgttttcgggccgaagaggattaacaaaacggaacatagaagccagcagccgccgatgaacaaaaagacgctgatgtagccgagcttaacggcaataaatccgacgagcagggagccgaatatgttggaaaaacggccgagcccgtatgccagcccgctcccggccgagcgatattccgtaggatacggctccgatgtgtaggcgtataagtttgaggtgaagatccgttccgtgacgttgacgacaaacccaaacacaataatcatgacgggaataaacgtcatgccgtataacagtccggcaatggcagtcagaaaggcgcttgcggccagaatccatttcctttggaacgtctcggatatcatggaaccgagcaatgcgccaagcggtgcgccgacagagtgaagcacattgtaccacagcgttttttccacggtgatcccgttgcttttcagcaggctgggcacccatgaagcaaagccgtaaaagccaaaggtttcaagaatccataccgctgacaggatgatggtgatctttaaattcctgccctgaaacagccctaagtagcctgcgtgcttcactgtatgtacttctgccgcctcttttggcgcgggaagcgggcctttttctttctctgcacgtgcttcaagacggttcataatggcgtttgcctgatcatatgcgccccgattttcgtgccagcgcggcgattcctcaagccggcggataaaaaagaaataaatgagaccggccgccccccatacgaatacgagccgccacccccatgagcctaaaggaatgacaaaagcggaaacaacgtttgtgacgggaaccccgattagaccgatcatggcgcaaagggagatgtattttccccgtacggaggatggaaaaaattccgccaaatagctgttcgtcacaatcatggcggccgcgacgccgagaccggtcaagaagcggaaaatcattaaggacggaatgtcccatgccagcgcattcagaaaagatgagatcgaaaagacaaggacaaaacaattcagcgcttttttcctgccgatccgatcggacagccttccgccgatggacgcgcctaaaaacatgcccaggaatgatgcggccgtgatgtcggcaatggtggacagcttcacgccccaatgctcaatcagcgccggagccacgttgctgagcgtaaacagatcagcgagatcaaaaaaatagatgattccgagagcggttaatacttgataatgcacacgtgaaatggggagacggtctaatcggttcgctacatttgagaatgtctgatgtttcataaaaaaccccctgactttgcaattgtaatcagaaaatactgtgaatttatctgacgaatacattataaaggtctttttttggcaaaaacagagtgtaaataaccagagccaaaggaaacggcatagcgctttcttcttaaaatatataacatttcctatatctgtttctgtttatattgtaaaatgttgaaggaaaggaagttgatgcataaatatgaatacgtttgtacgcccagcagagggaagaaatagtgtatcgagatatattctttctctgttggtcattgtgggtttgttctttttcggaagcatactgaccgtgttttatatgtttctcacgtccgctttcaatccttcactgacgataaattgggatgagggggcattaagtgacccgctggcggatatttatttacagcatatcgtctatttcatagcgattccgggcatttggatagcggttcgtttcattatgaaacggcggtttttatccatcatcacaccgaatcagtcgctgaactggaagaggattttctttggattcggcacatatgttgtgctgatgtttgtcgcggggctgattgattttacaattcatccggatcgtttcatgcttcaggaattccatgcttcacgttttctgctgctgttagcggcggccgtcttgttggtgccgattcaaacctctgcggaggaatttctctttcgcggttttctgcttcagttcgccggaaaattgacggcaaacgcggtggttctgacagtcattatcggcggattattcggcgcacttcatttcgggaatccggagatggaaaatggagctctctgggcgggaatcggatatgtcaccatcggcatgatctggacctttatcacgattaaaacgggcagtctggagatgtcccttggcggtcacgctgccaataatatgtttttatttatctttctcacagaggatcattcggtgtacggcggcattccgtcgatatttacaacagcagccggcggctatgaaatatatgattgcatatcgactctggtgatcaatatcatcttcgcatggctcgcattccgttttgtgaaaaaagaaaagcagcaggccgcctaggctctgctgctgatttgtaaggtgttcatcgcttcatcaatatccgtcgtcggcctccggcaggcgaaattctcacaaatgtagaccgttgtcttcccgtcgatcatttgataacccgcggcaaagtcagaaatgccggcaagctcttccggatgttctgcggcgagaatcgtataggcgggagtgaaatgctcctgaagcgcctcaatgaaacgttttctgtccgggtcatctttccttccgaaaacaacgatttctttttggggcattgtatgtgccagtacgctttgcatgaagaaagcgttgctgctcggataggcctctatttcccgtttgaacacagaaaacatcgcttcggctttttcaatcagtgatatatcacccgtcaggcggccgagacgaagcagctgtacggcagccgcgctgtttccggaaggcacggccccgtcataaacctctttttccctgacaagaagggtctcagcatcattccccgtaaagaagaaacctccgtgccgttcatcccagaacagctccagcatgcttgtacataacgttttcgctttctgcagataagacggattaaaacccgcttcatacagttcaagataagcccagatgagaaaagcataatcatcgataaaccctttgtttttcacttcgccctcgcgatagcggaccatgacgcgcccgtccggcatgaggtgccgttcgagaaagcggatcgctgtttccgccatgctgagaaagtcaggctcgtgaaatacctttgcggcttttgccagcccggcaatcatgagcgcgttccatgaggtcagcactttgtcatctgtatgcggatagcttctgttttcacgggcctccagcaattttgttcttgcctcttcaaggcgttcggccagctcatgtccggtgaggccggtctcttcgaggatggcctcacgccgcgtgaaaatgaggtgcgggatgttttcgccttcaaaattgccttgatctgtgatgttatacaccttgcagtaaagcgggccgagttcatcaccgagaaggttcataatttcttttttggaccatatgtaatatttcccctcacggccttcggtatcagcgtctaaagctgagaaaaagctgccgtcttcatgcatcatttcccgctgaataaacgttacgatctgcagcgcaatctgtttgtagcgctcattacctgtgacttggcaggcttctgtatatgcggtcaggagaagggcgttgtcatacagcattttctcaaaatgcggcacgagccattcattatcagtcgagtagcgggcaaagccgaacccgatgtggtcaaaaatcccgccgttcgccatgccgtcgagtgtcttggttacgccggccaaagcctgttccttgcccgtatagctgtagtagcgaagcagaaacatgagcatatgcggcatcggaaatttcggagcctggccgaacccgccgtacactgtatcaaacccgccggccagctggcgatacgtgtcatgaacagcctgttcgccaagcatgccctcggccgggtgaaccttgacttcaagatgagcggcggcgttttcggcgatatcctcgacatgctgccggtcattcgcaaacgtttcggacagatgttcaagcacatcgataaagcccggacggttaaatttgctcgtcttcggaaaatatgtccccgcataaaacggcttctgatctggggtgacgaacacgttcagcggccacccgccctgccccgtcatcagctggcagattctcatatacacggaatccacatcaggccgctcctcacgatcaaccttgatggctatgaatttatcgtttaacataccggcgatctcttcgtcctcaaaggattcgtgggccattacgtgacaccagtgacacgtcgaatagccgatgctgacaagaaccggcttgttttcgcgttttgctttttcgaaggcttcttttccccaaggatgccagtttacggggttgtgggcgtgttggagcagatagggggacttctccgtgattaaactgttgggtttactattgtttggcatgggctcacctgctttctattaatatttgtatgtttaacataccacaatcctctaaaaaaattcatacactcaactttgtgaaccacacccaagtcattaaaaaggagaactgcttatgactctattttcagggttaaacttcatctaccttattgctttttagataagaaataaggatttaaaatctttatcgttttatttactgttagataggtgaaacacaccccggcgactgtaaccatcccgcctgtcagtgcaataaacacaggtacttcacctaaccacacccaagaaatgaccaaggctatagcgggtgttaaataaagtgaaatggttgcttctgaagcaccgacgagtgaagttacatacgcaagtgcaaagtaaggcacaaccgttggtaataaacctaagtaaacgatagacaatgttgagttcattgaagcgttcaaaaactcttcccctaagccaggcaaaaacacaagcataggtattgtcccgccccaaatagtgaatgtaacgaatggaataaatccatatttttttatatagcgagcttgaaaaacgaaataaatactctccgaaaaagctgccagcaggattaacaaaatgccgttcactgaatttgtatagtttcctgccccaaatgaaatgatcgacacacccaataaacttatgatagagccaatccatttataaagcccaaaatgttcaccaaaaaacagacgagataacattgcagaaaaaataggtgtcatggtcacgagtaagcttgctgtccctgcgctaactgttttttctccgatattcagcaaaatgtgatatagtgcaaaacctaaaaatcctaacgataaaatagcagggatatccttcatgtcaggtaaacgcatatgagtcaaaacagcaaaaaccaacagtgccattgacccaatcaacaagcgaaacaaagcgaggtgttccggcgtgtaactctccaaacccgcgcgaattcccgggaaagctgatgcccacaacccaatcatcagactgtaagatatgccgattcgaactgttttcttttgcatctttctcactcctctttacaaaaaccaaccagttatttaatgtgtttctatattaataaagatttgatgatatgacttcaaccagttaaatagattttgacccaaccacttttaaggaggatcctttttatgagcgctccagaagaaaaaaagatgaaaaagcttcctaagtacatacaaatcattcaatttataaaagagaaaataggaaatggagaatggccgattggaagtaagattccaagccagcgcacgcttgctaaacactttgaggtgaacaggagcacagtcattacagctttagaggaattgacggcggatggattaatcgaaggcagaatgggcaaagggacagttgttacgaacaatacatggacacttttggctaagaattccgctcccgattgggatcagtatgtaacctccggaatccagcagccaagccaaaaaatcgttcaagagatcaataaatcagaatcgaattctgatcttatacagctcagtaaaggagaactttcacatgagatttttcctttagctgttatgaaagagatcatgggaaaggtatctcaaaacatagaggcattcgggtatgaggaaccaaaaggctatttgcctttgagagaggcattaagcggctatttaagaacaatcggcattcaagcgtctccttcttccattcttattgtttcgggcgcactgcaagccttgcagcttatatcaatggggcttttacaaaggggatcgaccgtatttctcgatcagccttcctatctttattcattacacgtatttcaatcagccggtatgaagctgactggagttcctatggataataatggacttttgccggaacacatccacatggcaaggggggaacgggggagggctatcttatatacaaatccttgttttcataatccgacaggtattttaatgtcaaaaaagagacgagaagaaatccttgcggcaagtgagaatgcacagcttcccattattgaagatgacatttatcgtgagttatggatagatgagattcctccagatcctattaaaacaatagataaaaatgggcatgtgctttacataggcagtttatcgaaaacgttaagtccgggcttgaggattggatggatcgtcggtccagaaccagtgattgaacgtttatccgacataaaaatgcaaacagattacggctccagttcgttatctcagagagtagcggcagagtggtttacatccggtgaataccagcaacatctagaacaggtgagaagtcaattaaaggtgagaaggcaattggtcatgagtctcttagaaaccaatttgaagaatgtcgctgcatggaatatgccgaagggaggattctttgtctgggtaaaaatattgcctttactatctatgaaattactttatacaaaagctttgacaaaagggatacttctcaatctcggcagtatctatgctcaagaaaaagggaattatattcgcttatcatatgcttatgcatctcttgaagaccttcaaaagggaatttatgaattgggtttgatgattaaggaattggcaagcagataaatataatgattactaaaagacagggacatgctatcaatgacaagaatctgcttgttttcgcgtttcgcttaattcaaatgcttcttttcccctcatgaaaaccagtaaaaaagccgccaacaaagcggcttttcttaagttaagatgccgaatgtcaaaaaaatgttaatttctgctctccttgtttttattcaaacttcaatctgtatggctatgtctctcctagaagaacagcggcttggttcttgaagagtaaatcatttacagaaattcttatatctacagatgaagaatagcgctttttctattatttagatcattgggccgtataaccgccgtccattacgactgcctgccctgtaacccctttcgctttgtcactggcgaggaatactgcgtaatcagcgatttcttgcacggctaacaaacgtttttgaggaaccaaggggtaaatgacttcttcaaacaccttttctttagaaatgcctctagtctctgcaatatcttttaactggttttgcaccaatggagtgtcgatatatcccggacacaaggcgttgacggtaattccgtattccgctccttccaatgctgatactttagttaaaccgatcaaaccgtgtttagcgctgcaataagctgctttccctgcaaaaccaattaaaccatttatggaagccatattgatgatgcggccaaatttttgttttttcatcaaagggaatactctttttgtcgcactaaaaggagcagtaagcattaatttcagcataaattcaaacttatcagtcgggaagttttctatatccgacacatgctgaatccccgcattgtttaccagaatatccaatcgtccaaaggtttcaagtgtcttagagacacttttttctacttgttcttcgtttgttacatcacaaaccgcagagaggacttcgtatccttgttccgtaagttcctcagctgcatgttgcacggctttttcgttcaaatcggaaatcacaacttttgcgccttctttagcgaattcacgtgcaatttctaaaccaattccactcgccgcgcctgtaacaagagcaactttactttccaataatttactcatagtaacccctccaggattcattttggtctcctaaaagtttacacccagcagttgtataagtaaaatgaataaaaagaatataatgtattcgttaaacttatggaatggagatcatacgatggatatacgccaaatcacttactttcttgaagttgctaaatccaacagttttactaaggcatcagaaaatctgcatttgtcacagcctgccttaagtaagatggtgaaaagtttggaagaggaattaaaggttgagctcattgatcgatcagctagacaaatcgctttgacagatgcaggcgaaattgtatttgagcaaggccaaatgattatgaagtcaatagatgacttgtcgacgaacttatacgatctcttacatttaaaaaaaggaaaagtgaaaattggaataccgccgcttatcggtgtcttgttttttcctaaaatcattagaggatttaaacaattgtatcctgatgtgagcatcaagctgatagaacatgggggaaacaaggtgaaacaggaggttgaagatggggtactggatcttggcgtggttattgaaccagtggacgaagagcagtttgatatcattccattgcttaatgaagaactgatgctcttcgttcattccgctcacccgcttgttcataaagagattgtggaaatgcaagacttgaaaaatgaacctttcatcctgtttagtgaagacttttctctccacgatcggattattcaagagtgcattagagctggtttccggccgaatgttgtttatgaaagttctcaatgggattttatcagcgaaatgattggagaagaactagggatttccattttccctcagtctatagtgaaaaagactgatcaaagtttagttaaagcaatttccattgtcaatccatcaattccttggaaagtggcgattattttaaaaaaaggcaaatatgtttcatacgcagtacgcgaatttatccggtatatttcaactttttgtaagagtaattacgcagataaagaataactcatgaaaaaaatgaatgatttttatagtttttatgtattttacggttagagagggctgcgatatattatcttatatcagaaaatcagtacctttcaggaggaaattcaaatggatcaaaaccgttaccaacaaggattagacaaattaatggagtacactttaacaagcgatgataaaatctctacgcatttaaagatttcagaagacttgaaagatatcgctccggatgtaagtaagtacattatagaatttgcttatggagatatatattcacgaccgggattaaccaaccaacagcgtgcccttgtcaccatctcatcccttgtcacgcagggaaccgaaccgcagcttgaacttcatatcaatacagggcttacatccggattaacaccgactgagattgtagagagtatcacccaattggttccttatacaggattcccgcgtgtacttaatgctctttcagtggctaagaaagtgtttgcacaacgacatgtagaaaaccattgagaaataaagagcttggggaatgcgggatgaattagtataaactcatcaatagaatatacacaaaacgacagcctataaggctgttttttaatagtctcgcttatcataaaaaaagtctgtgccaggcctatatatggtctcttttttattttcggttgatcatatgtaaaagcgattattttaatcgctttttgatacttcaaaacatgctaagctttgacctctttatcagtaagcacttttaaagcatctctcacttttaaggcgaagttgacaggtttatcaatcgattcgaaatgaatatacatcagtctcggtttatcaaacagccagtgattgtgaagtgacgttacagtcagatcatgtttccgaaggacgctgataaatggattgatttctttttgcagaatgacagtttctccgctgcaaagagcacggccgtcttttgtcattgattcaaatgaaaacatttgcggaatgagcaagaatgatcttccgggccgtccaagtactacaggttttatattcgttcgtgatctcattactgtacaaattccattttcaaacgtatgcatggttccgcctagaatatcgttgaactcgtcacaaagaccatgccgttcaatcatttccccgtcagtttttggtaccgcacgcacagttttagtagttagaaccctcagggcctctctcacttttcttgcaaaattgagaggtttatcaattgattcaaaatgcataaacatcaggcgcggtttatcaaacagccaatggttatgaacggcagttacgatgataccgaatttgcgcagctcactcattaacgggttcacttcttcttgcagtaaaacagtctcacctaaacataaagctctgccttcccgatccatgctttcaaatgaaaaggcctgaggaataaaaggaaatgcctcggctcttcttccgagtaccaccggatgaatgttgcttcgaaatcttgtcgccgtacatacgccgtttacgacactgggcgttgaattgagaattctagcaaattctttgcagagccgtgatggctccatactcgtttcttccacttcatatctcctcctggaatctatttataacgtacgtagtattaaagatatgtgaagatagaaaaaatgtaacgcgtcagcagtccatattagagagaatcagtctttcttgtataatttgagattttcttccctttttacaatctctttaactgttaatttttaatagattaaaagcttaaattggtagttttattccagctttgatttttttgtggcggtcatttgtgacaagcaccggctgagcacacataccttttagttgtgagtttcagaatatgaaaaaaagcctttatacaaggctttcggtaaataattcatacagccgtttggctgctcattcagtgacagctcacagctcttttgtcatcaagacatgcgggatgccgtcttccataaattccggtgaatctgtctgatagcccagtttgtgataaaagccttccgcatgtgtttgtccatgcagtttacattgggtgatgcctttttcttttaccatgttttctaattcgcttatgatgactttgcccaacccgtatttgcggtaaggcttcaggatgcagattcgttcgagcttgcctgtatggtttacaatgcggacgcgtcctgtgccggcaggctgattttcatgataaaccaagacatgcccgcactgatcctgaagcgtatcgaactgatcaaattcatcggattcaggtacttgctgttcctcaatgaatactgcttttctaatctcaagcgctgcttgcaaatcaatttccgttgttattctttttatcttcataatcaaccaatccttttcacatgttagtctggactgcacggcttgcttgtggtcttatagaagtaacgataaaataattatattgcaaatgcaacaaaaatatgaggggtttgaaaagatatgactgatattttgcgggaaatcggcatgatcgcacgggcactggattccatcagcaatattgaatttaaggaattagacttaacaaaagggcagtatctctatcttgtgcgtatatgtgaaaacccgggagtgatacaggaaaaagtggcggaaatgattaaagttgaccgaacaacagcggcgagagcaatcaaaaaattggaaatacaagggtttattgaaaagcgtcctgatgatcaaaataaaaaaataaaaaaactgtttccgactgaaaaagggagaaaggtttatccgttattgcaaagagaaggagagcattctgcggaggtagccctgtccggctttacatctgaggaaaaagaaaccattttcagccttcttcagcgggtgagaaaaaatatagaacatgattgggaatttgtgaagaaggggaataaaagagattattaatggtcattaattccttttagtgaatgattgcgttgtgaatgattaaagtcataaatggatacgttatctgtgacatctccttcctcggttcctgcttcaacatagccgataggcttatttttaacgaaaagtatcaattatggtatatttaaataagaaaaaataattgaagcggggaatgatatgagtacaatcgaaaaacaaagacgtaagaaattcagagcgaaatcaatcgtacgggccatcatggtcatcatcggcggaattattgccgcgtatggactggaaaccgtattgattccgaatagtgtatctgacggcggtgtgaccggactcagcattgtcggttcacagctgtttcatttgcctcttgggatcttaattgcggtgatcaatataccgtttgtctggttaggatataagcaaatcgggaaaggttttgcgtttctatcaattatcggtattgtctcacttgccgcgggcacgagttttttccaccacacaccggctatcattgagggagataccctgttaatcaccgttgtcggcgggattattctcggcttgggaatgggattggcattgcgcaacggcggcgccttagatggaattgatatgctggctgtgcttctgtcacggaaattgccgtttggcacgagcgacctcattttatttttaaacatgtttgtgtttatttttgtttcttttgtattcgggctgcaaggcgcattgctttccgtcattgcttactacattgcatctaaggtgatccatgtggttgaggaaggcttaagcggttctaaaacttttcagattatcaccaatgagcctgcattaatggtagagaccattcgtgaagaattgggccggagcgctacttataaagaagcatacggcggtttttctcatgaaaaattccaagaaatcacatgtgtcatcaaccgtttggaagaaaccaaactgaaagaaattattaatgacattgataaacaagcctttgtgacggtatatgatgtcgcagaagtaaaaggcagtaatttcagaaaagtccataatcattaagaagcgagctgccgttaatcggcagcttttttaaaaaaggagaaaaaacttgcaaaaatagaatgacggctgtatattattgatatatcaaacattgactagtcaattaattgcgcaaaagaaagtggggatgggttttgacagcatgttgttcagaggaaggcgagattttatatcagctccaatcactgcataaagtgatcggcacgaagtttgaagcgtgcaccggaatcagccaatcccgccttgagcttctcgccgtgcttttttacgtcgacgagatcagccaaagcgatcttcagaaaaaggtgaatattgatggtgcagccgtgacaagacacttgaaacagcttgaagccaaagaaatggtcacaagaaggcggaagcccgaggacaaccgaattatacttgtccggcttactgaacaggggcgggagagaatcgaggcttccaaaaaggagaaggagcgtttcataaaggaaatgcttgccggtgtcagcgcggaagaacgcagtatgttaaaaaacgtattgtcacagatgcagaataatatagaaaatatgaaagcataggagtgttttacacatgaaaacagaactgaaaacaaacgactttatggacattatgaaaggccgccgttccattcggaattacgatccggctgttaaaatcagcaaagaagaaatgactcaaatcctggaagaagcaacgacagcaccgtcttcagtcaacgcgcagccgtggcgttttctcgtcattgacagccctgaaggaaaagaaaaactcgcgccgcttgccagctttaaccaaacacaagtcagcacatcatctgcggtgatcgcggttttcgcagatatgaacagtgatgactatttagaagaaatttattcaaaagcggtcgaactgggctacatgccgcaggaagtaaaagacagacaaatcactgcgttgacggcgcattttgaaaaactgccggagcaagtgaaccgtgaaacgattctgattgacggaggactcgtttccatgcagctgatgcttacggcgcgcgcgcacggctatgacacaaacccgatcggcggctacgataaagaaaagattgccgaggttttcggaatggataaagagcgttatgtaccggtcatgctgctatcaatcggaaaagcggcagacgaaggatatgcttcctaccgtcttcctatcgaaacaatcgcacaatggaaataaggttgaagtgaagctgaggggagagggacagtggagattattgcagctgttttcgtcggagttgtagctttagaacatgtatttatcatgatacttgaaatgttttttatcaattcgaaggcagctaagcggtccttcaaattgccgaagcatttagaaggtgatcggaatgtagcggtcatgtttgcaaatcagggtctgtataatggatttctggctgccggcctcatttgggggctgatcctcggagctgatccgattggccatatgattcaattatttttcgttatttgtgtggtcatcgcggcctttttcggaggctttacttcaaacaaatcaattatcgtaaaacaaggacttccggctgttttagcgcttatttttcttttattggcgtagcagacggaaagagggcttccggaaaggaagccctctttttttattctgttttgaaaatcattccttaggcggatcttttttgaattacagataaatgcttaccgcagaatagatgagcagcagacacatcacgatgcgaaacgctttatcgtgtttctcaaagagatgtttaaaaacagagccgaacgccgaccacagcagtaaagccgcccagcccaggagaatagccgacgcgagccagaacgcaatcaatggatacgtgtgctgaaatggcaatataaaagcgctcattaaggttaaaaagaataaaatactctttatattgatcatttgaaacagaaatcccgatagaaaagacgatcgggttttttcagaatcgccttttgatgttttgggcagcgagatctgccaagccaaatagagcaaatagacggctccggcaattttaaagtaaggttccacgacgggaatccaatgataaacactcatggtaaacagaccgctgagaatgccgagcactgcaaatcccgtcaggatgccgccgttaaaacgccatgaaccgataaagccggctctgcgcgcttcattcatcattaaaatattgctcggcccgggcgtaatagatgtcatcaggacataagaaagaaaagctatgatactcattaaatcaccttcatttgctaatgtgatggaaccgttttttattgtatgataagaatagttataaataaaattgaaaaataaaatcgcattattgattttttcgatacatcttagaggtgaattcatatggagatcagacatcttattacatttcaggccattgtagataagggaagctatacaggggccgcggcgaagctgggatatacgcagtcgacgattacgactcatattcaggcgcttgaacaggagatcggcggcgcattatttacgtacgaaaaaaggcgtctgaaactgacgcctttagggagagagctgataccgttagccgaggatttactttccgcccatgacaagatcaaaaatatgcaaagcattcacgaggtgaagggcgttttaaaaattgcggcgccggagtctttgaccatttccagactggggccgattatcagagaatattccatgaagtatccgaacgtcaatatcatattgagcaacggaacatgcgggcagaatcaggtggaattagtaagtggccgcgtggatatcgcatttatggtgtatccggagatacaaatggaaaaatgcatacatcattctttattggaggaacgcatcgtcctcgtggcgggcagtgacgcaccggaacattttgacgactatcaacaaagcggcaagcacttttttattacaaatgaagaaggatgcagctatcggactatgtttgaacgatttctcgtcaagcatgatatcagtcatttacaaacaatggaattgtggagtatagaagcaattaagcagacggtgatgagcggactcggtttctccgttttaccttatattacggtaaaagaagaggtaaaagcggggaagctgaaaattcttcagcagtctgagccgttcgagcggctttattctcatatgctggtcaaaaagaaaaaatggcagcttccggccgctgaagcttttgtgtcgcttgttcttgagatgataggttaatttgaaagccgatgcctgcgcgcatcggcttttgtttttgtccggaatcttaatgacattttcgatgtcagccagctttgactccatacctaccttttttaaaaaaagagagctgatcagcaaatatggtatgatttacataatcagggagtgagaagatgaatatgaagagagcgtattatgctattttatacagccagaccgctatcaacttggggttctcactttatacgatggccgtcatcttgtttttgtttacaaaaaccggttcgacggcgatggcctctcttatgacgctcgtcagcattgtatgtcgcgtattgggcagcgccgttttgccgctggtcaccggccggttcacgcttcgttctttgttaatcagttctcaattgatacagatcacactgttagtctgtttgttttttgtcatccaaaccggttcatccgcattcttttttctgctgttttgtctgatcggaggcatttctttttgcaacggatggtttgctccgataaaaagcgcgctgattggggaaatcattcctcctgatcgaagggcgaaagcgaacggtttattatcggcggcggatcagaccgttcagtttgcggggtggtctctgggcggcgtcatcatagcgttcctgggagagagcgatacaatgatcgtcactgtcatgttattggtttcttcggtgttgggcatcattctgtttcttcaagtacgcatgtgtgcgccggcagcagtcagggaacgttccctttttgcagatgcggcaagcggctgggtgtatttatttcagcaaaaacagctcagggttctcattgtgatggatgtgatcgaatcgtgggcaggcatgatatggatcggttctgtgtccttgacttatgtgcatgacgtccttcataaaggagaggcttggtgggggtatgtcaacggagtctattatgcagggacgatgatcggcggactgatcatctataagttatccggtaagtttcagcatcatctcattccgcttatgctgacgggagccttggcatatggaatgttcacgtttatttatgggttgatcacaagcgccgttactgccctttttctggtgctgtgtatggggccggcttgtgtattacgagatctcacgcaggaaacattccttcaaaacatcacgaccgaaaagacacgggtcaatatattagcggcgagatcagctttagttcagttcatttttatgttttccattatcggaacgggggttatctcggatgtattcggcgtgcggtttatttatattggcgcaggcctcctcttattaatttcggcttttatcggattttctcagctgcgaatgaagaagatggtacaaagtcgcatgtagtgtagtataatgaggaacgtacgttctatatcgagagaggagagggtaatgtgggacatctggcactgcaattgtatgattatcatctttgggcaaatcagcaaatattcacccggcttaaagagcttccggaggatgtgtatcgtaaggagattcaaagtgtctttccgtcgatagccggtgtattgactcatgtgtatctgtcggataaggggtggtttgatgtgttctccggagagcgtctggaggatacgctgaaatcagctgaacagcaaaaagaggacatcttgtctaaagagatagaagagctggaagatatgttctcggaattatcagaccggtatcaattatttttgcaaaaggaagaaaatatcagtctccctcttgaaatagagcatccgtcaggtgacatcatgaaaaccgcagcggccgatatgatcctccatgttgtgaaccacggaacgtatcatcgcgggaatataacagccatgctcagacagatggggtatgcttctgtgccgacggattacggtatgtatttatatataaacaataagtaaacaagacagccaacgcggctgtcttgtgatatccgtaaaaaagccaaatcatatgagtgatttggctttttcatttgctatgccatgttctgcagccgttctaaactgtttttccaattcgcttcaagcgctgtaaaagcagcggcggcatcttgctgttctaatgcgtgaatgatatcagagtgttcattatatgatctgtttaaagcgccgttttcactgaaatagcggatttccagtctctgaattttgactttcaggcttactagcaatttgtgaagttcagcgttgtccgcaagtagaatgatgcgatggtgaaatgcattgtccgcttccaggatggccagtttatcgccgtctttcattgtttgaagaagattttcattcagctgtttcaattcctgaatcacggcatcgtccacatgcgggagagcttgctgcaatgcgagtttttcaagcgtccagacgatggaatacaagttttccgcttcttttaactcaatcggagcgacaagcgtccatctgttcgcttttgttatcaccaagccgtcatcttccagccgcaataaggcttcccgtatcggggtgcggctgattcccaatgtttccgacaaatccttgtcctttaactttgtttccggtttgagcttgcccgttatgatccagtttctgagtgtgcgatacacttcgtcccgcatgatggttcttttcagcacaggttctttgttttgattatccaatggaacacctcatgaatcgtagtatacatatttgcattttaccacagtccgggcgctggttagaaatgaagagggacgtctaagaatgaatcgaaccgagatgcttcatctcaatatgctgaaagtcagcggagccgccttcagaaaagagcgtgattccctgatcttcgtgttttgggaacacttcatttgtcaaaacggtttttccgtcgtctgcaaatacttcaatacttgttttatccacgagaattttcagatggacgcgccctttgtttccgtcaaatggggctttgctttcggcgtatgcgccggttttatcaggctggtctgtaaacgatctgttcacataggcatagccgtcttctgccgaaataccgacatcaatatgccgactttggtctgctgattctctgagtctgacgcctgcatttttgatatctgaccaagcgatatccatatcaagctgatatgtatcacctttgatcggcagtgtctctgaaccgttcacctgtttgtgttctatgctgtcagttgaagaggttaattggttcaatgcttcaaccggctctgacacaaggctgtatgtgccgccgtcctgctgctgaaggcggatttcacggacgatagaatccgtaccgttaaagccgttttttagtgtcggtgtttcattcggataatcccaattgttcatccatgccagcgcatagcgttttgtcagcggatcttcgctattaccgtcctcaaatgtgacgccgccgtaccagtcaaagccgtaatcgagccattgcggttcttcttgatcggcggaaaattccttcccgtcaaagtttccggtccaatacgcgtacgtattcggtttgcctgcgggtttgccgtttgcgcttgcgcccagaacccacttggctgttccgtcatctgcacgcatcatataaaggtcggggcattcgacgaggccgatctgctgagtgataaaaccgcccgtgtatgtccaattttttaaatcgggtgattcataaaaaccgattttttcgccttcggccatggccatcacccatttgtcatcctgttcatcccagatcactttcgggtcccggaaatccttagttcccggatttttcatcacgggctgatcactataggaagtaaacgtttttcctttgtccgtgctgtaccataaatattgttcctgggcttttgttttggctgtcggctgcgttgtgacggcgaccagcgcgtttttgccgaagcccgcggtgttgtgtttatcaatgacgacagaaccggaccatatatcgccgttttcgttggtgtatttcggaatagccgtgccttcgtccgtccagtgcaccaagtcctctgatacggcgtgccgccattctgtgccgttgccgttcgggtaatcccgattataaagatagtagtaatgatatttcccctcgaaaaaaatgggcttttgagggtcgtttttccatttgtccggggtcgtaaaatgatacgccgcacggtaatctttcttatgctccgtgtttgtgtcagaggaattgtggcttttgttcggcagtaagccgacaaacaggaacgcacccaaaaagatcaatattacaacgggccattttcgtgccatgattgagttcaccatcttgttgagaaataaaagaaaatgccaatgaagtatcggcattttctttttgttgttattagttgttaaccgtaagctgtccttgttcaaggatgctgtttttaacaacggatgttttcttgcctttgatgttcattaagaagcttggcgcaaatgttgcctttttatcctcaaagaagcctctgtttgtcatgtagcttgtgatcacgacattgttgcctttggcttgcggcactgcgaagtgagagtaagtgaacgttacatcgttaggatcaagacccatttgcagtacaagaccagttttgttcagcggcttgtaaggacctgttaaagagtttgatacataaccaagcatgtagatatcgttggagttaataccgtcgatcgtcatttttgaaccgcgtgaatcagtgaacagataccatttgccgttcattttgaaaacattcgcgcgctcgatttcatcagttaccgtgtttgaagtgatcagcggcttcatgacttttttcaatgtgtagtcattgtttaattctacgatgccgagggcgccgttcgctaattcagcatcgcgttttttagcactttgctgaagcttctgactttctttacggaagaagtttgtgctgccgccgtagtacgctttgttaaacaaagattcttcgccttggtatccgttatctgttcccgtgttggcttcgaatacaaggtatttatggcctttgtcttcaacgtagtgagggtctctcagcgtatggttgtcgccggatgtatagttcccttcatcgataaactgctgaacgttttgatatgtttttccgtcaccgtcaaaaatcgttttatgatcttccactccgttgatcttgagcgtgtcatcagattttgacacatttacctgcgccgttgtcaggctttgtttgccgtaatgtttaccggaaaagtcagtgtagaataaacggattttcccgtcagatgtaaaggttgcagaaccggaccattcttgtgtctgttctttcaggatttcatcgttggcgtcgaacttatcgctgtctttaaagacacggccagcgtttttccagctgtcgatcgagttgtcgccgactttttgataaaacatgtagatggatgtgtcatcagcgtctttcgggcttccggcaagagcaaacacgacgtgatagccgttgtattcagctactgttccgtcagcgttttggagcggccagctgtcccacacatccagtccttttgcggactcgatatttttaattgttgattggtcgaattgaggcacttggtatttttcactttgctgctgtttagggatctgcagcatatcatggcgtgtgatgtgagagacgccgtacgtttctttgtaaggtttttgggtattttctttcgcgaaggcttgagtcgctccccctgccagaagtgcagtcgtaaaagttagaactgtggctcgttttgcaaattttttgatgttcatgttcatgtctccttttgtatgtacctttttttgcgatctaccgattcgctcctcctgcattcatggatggcaggtttgttacagaaaaaaagacctaaaatatgtatggggtgacgccaaagaattcactttgcccttaacacattttaggtcttgcctgctttatcagtaacaatcctgcatgatttacttgtcgacatcattctattagactctgattctattgacaactggtctattttcctcttttggatgatagtaaaatgaaaaaaggccttttaatatatgggtaattgagactaaggggtgctctgggcctaggaaaaaacctctctgaaaaagagaggttattttttcttgatagataataaagcgatggtagctaaaatcagcaaagtacccagccattctgatattccgaagggaacatgcagccagatcacagctaaaaaagctgccgacagcggctctgcacaagcgagcaggctggtttcagaggcactcagatatttcaggctttccaagtagcaataaaaagcgatgagcgttccgaaaatgatgataaacacgatcgcggcatatgcaggaaaggaccactcgccttcaaatttccagggcgggcggatcaagctgagggcggctccgccgatcagcatgccccatccgacaataatggcagatccccatttcttcagcagacgatgcggctgaagggtgtaaaacgccagtgcaaacgccgaactgatgccccaaaagacggccagaccggatacggacaggcttccgacattcccgtgcgtgaccaaaatgaatgtgccggcaaccgccaataagacggcgagcagctcttttcctgaaggaattctctttgcgcgaatcgctaaaaagcatgtaatgatcgctggccctaaatactgaagaacggtagcagttgccgcgttgccgtactcaattgccgcgaagtaggtgtattgaacgcctaacattccgaaaatcccgaataaaagaaggggaattctgtcccgtctgtctttccaaacagcccatatccgtcctttttctttgcggtacgcgatgccgagcagaagcgcccctgacaccagaaggcgcaccgaagtcagccattctgtattaaaatggcggtgctggaacagatactgggcaaccgttcccgagaccccccataagatagctcctgtaagcacaagccaaatgcctgttgttcgtgaataagaaagagcagcgtgtttttccaggatagacacccccgattctgatgttctgatattaacttacaataattaggaaaacgaactccttacatgtgatatattatatattgtatattaaattccgtcaaaaagattttcggagaaagctcttacaaaacggccgtctgaggaatgagctgtaaaaaaaaacaccccggcgggttgggactgacccccgtttttgagacagggatcaaaacacctttaagcagccagctgtcggtatgtgaccggcggctggttgtttagtttcgtttgaatacgaatgttgttataatagtgtatataggtttcgacagtttgttctacgatggtcgtcgtagtgctttccaacctgtcgaggtagaacgtttcagactttagtgaggaatgaaacgattcaatggaggcattatcagcgggcgtccctttgcgggacatgctcatggtaatgccttttgttttaacagctttctgatactcataagatgtataaacagaaccttggtcactatgtaacacacagttctctggcagtgcgggcagctgatcaagtgtgtgtaagacaaagtctgtgtcctgtctatcgccaatcgtaaaagcaatcacttctccattgtataaatccaatatactggaaagatacaattgtttctgcccataaggcaaatatgtgatatccgttactagcttttccagagggcgatcagactgaaagttccgatccaatatattctcggccacggcatatggctgcccattcttcttgcgctttttcaccttaacccggcattgccactgattcttctgcataatgcgctgaaccgttttatgattcatacgcattcccttttttaatatggctgtgattttccgatagccatatcgatacttgtgttctcggcacaacgtgccgatttgtttttctaaatggtatttagggttatctttcatcagattcttcttccaacgataataagatgctcgtgagatacctaaatgaatacagatatcctttatggtcattgtgctgcgcaatgcttctacaagctcgactggcgtttcgctatcagcttcctttccaattcgttgtacttttttaacacttcattctgttgtctcagataacaattttctgcctgcagtttctctaattcggaagaatactctggaccttttccataagaatattgctttccgacaggttgttcgaatcgatgtgtgtccccagctttataccacctgacccatgtctgcacctgcgtcttattctttatattcaattcctgcatgatctccttcacaggcacgcccgccaatctcatttctacagccttctgtttgacttcaaccggataactcactcttgccctcatagaaaaacacctccaagtctaatttcggataacaacgatccgttttcaaacttgaaggtgttttttgtttgtctcatattatggggtcagtcccggtttccggggtgttttggttattctgcaatcgcgtctgttaaaacaggaacgacttgtttctttctggatacgacgccttttaaaagagccgtgttgttttctaaagtcacgttgaatgctttttccacttttgacgcttgatcaccgatggcaagcgcaagggaatcgttttccagaatatccgtaatcacgagaaggaacaggtcaaggttcttctcagcaattacttttgaaagagccgcttctaattccggctgacgctttttaacatcttcaatatcaactgtgttgacttgggcgatttcgacttttttgctgccgagcgtgaactctttcgcatcaagagaaatcagttcttccacagtttttttgcttaagtcggcgcccgctttcagcatgtttaagccgtactcttccgcatctacgccggcaatttcagcaagctcttttgccgctgcgatatcttgctccgtgcaagtcggagatttaaataacagagagtcggaaatgattgctgacagcatgaggcccgcaatttctttctcgattttcacgttattttctttgtacattttgtttaagatcgtagccgtacagccgaccggctcagcacggtagtaaagaggttccgctgtttcgaagttggcgatacggtggtggtcgataacttcaagaacctgaacgtcttcgatatccttgatgctttgctggcgttcattgtggtcaacaaggatgacgccgtttacttcgtttgcggctgtttccaccaaacgcgggctttcctgcttgaaataatcaagcgcgtattgtgtttcgccgttgacttgtccaaggcggacgggctcagcattgaagccgagtttattttttagatcagcgtaggcaatggcagagcaaatggtatctgtgtctgggttttgatgtccgaaaataagaattttttccataataactccttgtccttttttgtagtgtaaacaatctttttatagtttaacacgtcttgaggagggtgtaatcttcaaaaccttaaaaattgatgtgaaaaagaagcatttttgttgagaggtggagaggattgcgagtaaaatactgggtaagtcagatgctaatcagcatatagtatcaaaaaaggtactatggaggatgaaaaatgaacatatatccgaataaagaaggttgtccggttgaactgacgctttccgttatcggcggaaagtggaagggtattttgttttatcatatgatcggcggaaaaaagcggtttaatgagtttcggcgcatttgccccagcattacgcagcgtatgctgacgcttcagcttcgcgagcttgaggcggacggcatcgtgcatcgcgaggtatatcagcaggtgcctccaaaggtggagtattctcttaccgaattcggcaggtcgctggaaccgatcgttttgcaaatgaagaaatggggagatgccaaccgggagtttctcgagacataccgggaaaaaacgtctcctcaagatcagtccgctcaaaaataagaagcagcaaaggattaaattccttgctgctttttttttatttcatcgcgatggcctttctggcgttgcgcacgtcatttttcagcaattcgctcaggttgtaagccggatattgaccgcgttcttccatatactcaaagaccatttgatgccacttgatggccgcatttaagtgcttgacgaagacgtgtcttaattgaggtgtggccgtctctgtaatggctccggcataattgcggacagatgttttggccagaatgagcaggccgccgctgtaaaaggaggaatcagcgcgctcttctgtttcatcctcacgaaaagcgggagcttcagggaagaaaggaagcagttcacgcagattttgttccagcgaatggatggaaaatctgtaaagctgttttaatctggcgtcgcttacgtcccgctctgttctttttaatttcacaagtccgtttgcctggaaagccactaactcatgcagttctaacgtttcatgccatgctaatgttctccgctcagtcatggtgtaagaatctcctttatccttcattttcactatcagcatatgccccggttccgatgttgttcctgatgttttgaagtttccagaaagggaaaatcaatgtaaaggaaatacgaaatagaggtgaaactatatgtgggacatgataaagaactttttccttttcagcagcggggttttgcaggcgaccactctcttacttatcgttatcgtcttgttatatgtacgaaaaactaaaaagaaaaacagagatacttctggtttcatggatgatcaggatcactgatacaacgggcattctttcactgggatgtccgtttgtctgttttcatgtttcacatggaacattggggctgtccgcgctcattttacttgcgatttcgacttatgttaaaatatatacgtgtattttggagagtttatggaaaattcaggtcttgaaagagacattgcggcgtcaaaagagcagtcgtctaagctgctcttttctattcgtatgttcgaatgatacaaggtttgaggtgagtaagtgaaaaatacaagggctctaatagaaggcgccattttgatcagtatttttgcaatcatttcccttttggtcgtgtacctccctttactgggggcaattcttctctttgctttgccgctgccgatcattctttacaccattcggcacggtctgaagcccggggtatggatggggcttgccagccttcctgtcagctttattgtaagttcgtttaccgggcttacaggcgcttttacggcggcctgtacgggaatcgccatgggatattattttaaaaagaaacagcccggctatgcggttgctgccggcgctatggcgtatgtgctgtgcggcgtcgttttttttgtggtcagcatcgtgttccttaacatgaatgtggttgataccaccatgtcccagcttcgggagtcgctgtctgtggctgataccatgtcaaaacagctgggttacggagaccagttcgggaagcagatcaagctgatggaaagtcagctgagcacggttcaatatctttttccgacagtgctcgtattgaccggcatcgttttttctttcctcagttatgctatggcaaggccgcttttacggcgattttcccctgatcttccgaagatgaagccttttagagagctcaaactcccgcaaagcgttgtcattctgtattttattgtgacgatattagggtttctgcctttagaaaaagggcatatgctgtattcggtttcattgaatgggggatttattctcagcttgctgatttgtattcaaggattagcgtttatttttttctattgccgcgaaatggagatgccgaaagccgttcctgtattagcaattgtgctgggggtgctttttccgctcatcttgtccgtgtatctcctcttaggcatcattgacataggctttaacataagaaataaggtgacgcgaaattgagtgtgacttacaggtggggagttgatagaaatgcctagtttttatgaaaaaccgttgtttcggtatcccatctatgcattgattgcattgtcaatcatcataattctcatcagcatttactttaactggctgataggagccatcggcgttgtgctgctcgccgtgatcttgtttttcattaagcgtgcggattctctgatcagaaaagaaattgacgattatatctccacgttatcgtatagattgaaaaaagtaggcgaagaggcattaatggaaatgcctatcgggattatgctgtttaatgatcaatattacattgagtgggcgaatccgtttttgtcttcctgttttaatgaaagcacgctcgtcggacgctcgctgtatgacacatgcgaggccgtcgtgccgctgatcaagcaggaggtcgattcggaaacgatcaccttgaatgagcggaagtttaaagtagtgattaaaagagatgagcgcctgctttatttctttgatgtgacagaacagattcagattgaaaagcagtacgaaaatgagagaaccgtgctggcatatatcttcttagataactatgatgacgtcacacaggggctggacgaccaaacgagaagcacgatgaacagccaggtcacctcattattaaatgcgtgggcgcaggagtacggcatttttctgaaacggacgtcctcggagcggtttatcgcggtgttaaatgaacacattttaacggagcttgaaaacgcgaaattttcgattttggatgaaatccgagaaaaaacatccgtccacactgtatcattgaccctcagcatcgggatcggcgcatcggtttcttccttgaaggagcttggagatctggcgcagtccagcctcgatttggctctcggccgcggaggcgaccaagtggcgatcaaaatgccgaacggcaaggtgaaattttacggcggcaaaacgaatccgatggagaagcgcacaagggtgcgcgcccgggtgatttctcacgcgctcaaggagattgtctcagaaagcagcaatgtcattatcatggggcacaaatttcctgatatggacgcagtcggagccgcaatcggaatattgaaggtggcgcaggccaacggcaaagaaggctacatcgtcattgatccgaaccagatcggatcaagcgttcagcgtctgattgaagaaattaaaaaatatgaagagctgtggtcgcggttcatcacgccggaagaggcgatggaaatttcaaatgacgacacgctgcttgtcgtcgttgatacacataaaccatcccttgtgatggaagagcgtctcgtgaacaaaatcgagcacatcgttgtgattgaccaccaccgcagaggcgaggaatttattaaagacccgctgctcgtttatatggagccatacgcttcatccaccgcagaactcgtgacggagctgcttgaataccagccgaagcggctcaaagtcaatatgattgaagcgacggccctgttagctggtataatagtggatacaaagagtttttcccttcgcacgggctcgcggacgttcgacgccgcttcttatttgagagcgaaaggcgcagatacggttctggtgcagaaagttctcaaagaatcggtcggttcttatatcaagcgggcgaagctgatccagcatacgtctctttataaagaacatatcgcgattgcttctcttcctgagaacgaagaggagtactttgaccaggtgctgattgcgcaggcggctgattccctcttatcgatgagtgaagtggaagcttcatttgcggtagccagacgggatgagcatacggtgtgcatcagtgcgagatcgctgggcgaggtcaatgtgcagattattatggaggcgctggatggcggagggcatttaaccaatgcggcaacccagttatcgggcatttctgtctcagaagcgctcgtccggctgaaggaagccattgatgaatattttgagggaggcgttcagagatgaaggttattttcttacaagatgtaaaaggtaaaggaaaaaaaggcgaagtgaaaaacgtagcagacggttatgcacataactttctcattaaaaaaggcctcgctgtcgaagcaaatgcgacaaacatcagcgcattgaaaggacagaaagaaaaagagaaaaaagaagcgattgccgagcttgaaagagccaaagatttgaaagaaacgcttgaacagctgactgttgagctgagtgccaaatccggtgaaggcggccgtctattcggatctgtcacaagcaaacagattgcagaagcgctgcaaaaaacgcataagattaaagtggataaacggaaattggagctccaagacggtatccgcacactgggatatacaaacgttcctgtaaagctgcaccctgaagttcaggctgtgctgaaggttcacgtaaaagaagaagcgtaatacacaatgaaaaacccgccgatccggcgggtttttttcatgtcagcagacggcgcagcgcaagaaaatgatgagattgtttcatttccgatcatcactagattgcatattatattacatcataacgaaggatgtgtcggtatgaaacgatttttttctgaaacatattttaataatccggagaataaaaaggcgctggagcactatccgctgatcggtgatggaaaagacggggaagtctatcgcttaacacacaacaaatgcgtaaaatacttctttgaaaaagggacatgcaaaaaggaattggcagctttaaagaccggacaaggttccccggtgattccaagactgtatgaatacggagatcgttatattgtgatggaatatgtccaaggcacctctcttgcccgccatatcaaacaagaaaaatccctgtccgtcaaactgactgctgatattttaaatatgctggatgaattaaaaagaatcggttttaccagatgggatgccgaaatcaggcacattctgatcaacgaacacggaaatcttaaggtcatcgaccataaaagagctttttccgccattacccggtttcccgtaaaactattaaaaggactggacaaatacggcttggcggatgagtttttgaacactataaaaaaattaaatccgtcacgttacctggaatggcagccgcacatgtaagtttctgaaaatccgcacatgtaagtttcctttttgtagggtcgtcatatgatatttgtaacatttgtttggtggagtgtggaaaaaatggcagaatacattatggttatcggcgctcatcccgatgatgaactattgggatcagcgggcaccataaaacggctgatcaatgaaggatataaagtaatttccgttattacggcattaggaagaaaagaagaagctcatcatattaaacaattaggcgaacgcgcgaatcaagagcttggaattgagaaagtcatctttttggagcacacgaatttagagctggaatgtatccctcttcataagcttgtcaaagaattagagcagctcattcgcgtctatcagcctgataaaatctttacacatcattacggcgatatcaatatggaccaccagagaacattccaagcagttttaacagccgccagaccgcttccgaatcaaaagcctatcgaactgcttacgtttgaaacgctatcttcaagcgagtgggagaggaatacggctgataaactcttcaagcctaattacttcgttaacatcacagacacaatggatgccaaactcgcggcgcttcaccactatgacgtagaaatgagggattaccctcatccccgttcatatgaaggcgtaaaacatttaggaaaagtcagagggatgacggcgggtgtggaatacgctgaagcttttgaagtcgtgcggaggatctggaaatgatcaagacattttccgtcccctatccgtatatggtccagacgcttgaccgctactacggggtcaaaacgcgcccgcgaaaaaaggcggcagtaaagacacagttgaaacatgaacatcatattccgcggttatacaggaaaaaaaagaagttatccattttgattgccacgttttgggactacccgcacacgggcggtttatcaaactatattaaaacgcttagtgaaggcctgaaaaagagaggtcataaggtggatgtcatatcccctaatctgtttccgtccgtacaggtaaaagaactgcgggcggctgttgttccgaaattaaaagatttctttaaagacagatatggggtttataacgatcatattttgaaaaataatcggctgatgtttatatacgagcaaatgcttcaaaagattcatttggaaagatatgatgtgttccacgctcaagatttatttacagccaatatgttaggcaggttcaatcaaatctataaaaaacctttatttttcacaccgcatggcatgtttactttcaacagacttaaatttcacatctttaaaaaaggctcggtagaagagatttattataaaaaattagagatgaaagccattgaatacgcagatcgcctgattattatcagcgatacgttccgcagcccgctcatgaagctcggagccgaacaggaagacatgacaacggtggtcacaggaatcgattacgatgcaaaaacaggcgggaaaagaaaaaccccgttaccgaaaaataagatcatcatctcgtgtattgccagattaggcccgagaaaaggtcacaaatatttactggacgcactttcgagaattccatctgatgtacttgagcatgttgaagtgctgatcgcgggcgacggagagatgaggagcgccttagaggaacaggctcgaaaactgaatctatctatggtttcctttttaggaaaaagagatgatgttcccgctattttgaatgtgacggacatattcgtactgccgaccattaatgatagtctgcctatttcgattattgaagcgatgttcagcggctcggctatcatcgcgaccgattgcgggggtattccggatctgatccgccataacaaaacggggcttattgtcgagccgggaaatgcaaaggttcttgcccgggctttagcgttttttatcactaacaaatctgcgcggaagatagctgcttcaaacgcaaaggcctacgcagagaaatatttaagcagtgagacgatgataaaaaatatcgaatcgatttatcaaaataccaacagctcggagggagatcatgaaacatgaacatgcggccgttgtacttgatttcagtgcaaacgggatcgggatgattcgaagcctggcccgaagaggaatcgatgtttacgcgtttgacacggagggaccttatcgtatcggaaaatcaagattggcagattgcgggatatgtcccagccctttaacacaagaggaagaactgctgacatttctgactgatttcgggaagcgatttcaagtaaaaccggttctgtacgcaggatctgatgattatgcgggattcatatccaaattccgcgaaacattagccgatttttttttatttttgctcccgagccgctctctgttagaaacggttttagataaaagcaaagcatatgaattagcggtcaagcatcacatcccctgcccgaaaaccttttttccgaacaaccaggatgagctggaagaggccatcgccaatattgacttcccgtgtattttaaaaccggtggccggccatgaatacagaaaaaaagtaaacaaaaaagcaattgtaatgaaggatgccgcacaattgcgcaaggagttcagctcctacagagaaaatggagaactgctcgtgcaggagatcatccccggagacaaccagtgtttttataaagtcgccactttttatgatgaccaaatgaaattaatgggcttattctctctgcaaaagaaccatcaattccctgcagattttggcgcgggggcccacgtcgtcagcaaacggcttcctgatttaatcgagaagaccctgccgttttttgaagcgattcagctgaagggagtaggcatggcggaatttaaaaaggatccccgggacaatgtttacaagtttatcgaaattaatccgcgcttttggctcagccatagcctgacagaaccggcaggcgttcatttcgtttacatgtactatctgtatttgaccggacaacatgtgaagccccagctcgaacaaaaagacggaatcaactggatttatgaggtgcgttatttcttaacgtttttgaagaaacgaaaaagaggagaaatgacgttccgggatttttggaaagggtgtaaaggaaaaaaagagtacgctctttttgcttggaatgacccgatgccatttatcagaaacacttggtctcatctcaaaaacagctggaaacggaagcggaaggaagatcggcatgtatgaaaaggatcttttgtatggcgcatttcaaaaactgagaattgacgaaaaactgtcgtattcgttcggtgaaagggctgcggtgaatccggatgacatcacatgcctgaaatcgacggacagaagcgccatttataaactgtttgtaaagaaaaaatccggaactgttccgctgatattgaaggtatataaatcttcccgtgaaaaaaataaggtcgagattaatatatacgggaaagcccattctgttttaggggatttgctgccggatatctatcttatagaagaaagtgaccatgaaacgtggatatttatggagtttgtcagccagatcaggggacagcttacatttcacccgaagcatttcaagtatattattccgtctgtcgcagaattgcacagccgcacctttgaaaacaagaatatttctgacggtaaatggcggtcgtggctgccggtatatggatcggaaaccatgagaaaagggcgtaaaaagcagatcaaaaagacagcggaattattggatagggctcttaaagatgagcgcacaaaagatatcgtgaagcctcattatcggcaaatcacaaacttgcttgagcaggaggagccggattttttccctgaattgatacaaaactgcacagccatcacacacggtgatcttcatatgcagaatatctgcacccacgatgcgtccggacatgaaccgtgggatattcaattcatcgattgggaatccgcaaaatacgcgccggtttggtttgatatgacggtgctggttgaaattctgcttggcttcagaaaagattggagccggcacgcagaagatattcggacgtattgcgtaaaagtgtatacgaaagaaatgaaaaagcggggcattcattttcagacccctcctatgacgctttataaaatggcttatttgcagagaacacttgaaaaagggcttcatacccaattgcggagaatcttcgacaatcggggaggagaactgctgccgtatcatgttgacaaagtgtcaaaatggggacgggaattaggattataagtttgagagagggggagcggatttgaaagaagagatcggcaagccgaacggtctggtgcctccagccttattgcgcgtcatggatcaattttacgggatcgaacatcaaagtgagccagagatgctgtattcgttctgtgcggaaggaaaaagctcccctaaacgaaaaaagccattgcgtattctgtacgcaacttttctccgttacccgaatgtcggagggttggcgagttatatcacatcaattaagacgggttttgagcgcatcggtcatcaggcggatgtcatctcgccgctccaaatgccgccatctttttttcaggaagatatcccgcgggccgctgacgagatcagagcgtttcttgttggcagatacggcgccgcaaacgaaaagtttgtgaagaatctcagctatttacatgtctttcaaagatttttgaaggagaaagacttagaacaatatgacctgtttcacgcgcaggatttatttgcggtatttttgctgggataccttaatcaaacgtaccagcgtcctctttttttcacgccgcacggacattttacgaaaagccggatgaagtttcataaaatccaaaagggttcaatagaagaggcatatttcagtgaaatagaaaggcagggtattcgggcttcggataaaatcattacaatcagcgactcctttcacgagcccttgctggagtacggagcgaaggaggcccagctgaagactgttcataccggtattcacattcaggatgcccctgagtcaaaacgtgctgaaaagctcgtgatcgcgtgcgtttcccgtctgaccgagcgaaaaggacatgatgtgatgctggacgctctcgcccgcatccggcaccatttatccggagttgatatatggatcatcggagacggaaacatgagagggtttctggaagagaagagacggaaactgggcctctcaaatgtgtttttcctcggaaaacgacgtgatgtgccggcgcttttggctgaatcatctatatttgtcctgccgacattgaatgataatttccctatagcgatcatcgaagcgatgttctcaggtcaagccattgtcgcaactgactgcggaggaatccctgagatgatccggcatgaggccacagggcttatttgtcagcccggcaacagccgcgaacttgctgatgctctcgtaatgctgattacggatcagtctctcagggaacggcttggaaaagaagcgcgctcctatgccggccggcatctgcgtcaggaactgatggtttcaaaaatagaaagtatttatcaatcatttttctgaatgataccggcgccgcatggcaggtgcttcaagagcaaaataaagaggccggcgtttaactatccagcctctttccgaactattttttcatctcatacagagtctgctgactttgtccgcccgggccgcccgtcattcctttccgggctgagcttgtttttccggtgctgtatgggtcagctgagatttttgtgccgttctttttcctccatgagacaagcttcgtattgcctgaattgtttccggataataagaaatatttcacttttccttcgtcaacaagttttttcagctgtgagacggttaaaatcggatcggttccgttcaaagaatgttttaccaaaattttcttcgcgaaaaaaagaggcggaaagccatcgcttccgcctcccgcacatatatatgagagagcagcctttatttgtgatcgttctcttttgggacttcagctaatttggcaagcagaatgtgctgaggcatgtgcatgattctctcaagcggcatattcagtgattctgcgagcttttgcgccgtttcggcggaaatttgcagcggtttcatgtgatcactccttccgtttctttattgtactaaaatcagaaatctatcgtaagaggatatgacaaaggaatggaggtttgaaaagcggggctttataacagaatgggggaggttttttatgcaatcgccattgatgttattacagctgaagctggctgattatcagaaaaaagccgcagaactgcggacaattgacgaatttattatactgaaacagacattgcaggacatgatgaaagtattcgccgcctgtgaagaatgggagctgtatcaaaaaacggccgatctcatggcgcagacggtgctgcacatccgtttcatcgaataagaaaagccctcgctcgggcgaaggcttttcttaaaaggaccgttcttcttcaatgtttttatgctgatcataaatgacaagcttagacgggctgttctctttagccgtctgctccgctttctcgatcgccgcgtcctttgatgtataaagagctgtcggcgccacattttccaccttcacaaaccatccgtccgcatcaacactgggtgttactgcatatgttttcatccttcttacctcctggtttcgatttatttatttgtttcccggcattcggaatggcgaaacacgcagccgctgtttgacaaatacagggaaagagatgtttttctattctttttcttgagaaatggtaaaatggagtttggatattttttaaggagaggacggtgcttagcatgacagaccttctgaatgatcggctgccgccgcaaaacatagaagctgagcaggccgtgttaggtgctgtttttttacagccgtctgcgttaacactggcttctgaagtgttgattccggatgatttctacagaatgtcacaccaaaaaatttacaatgccatgctcgtgctcggagaccgcggtgaaccggttgatttggtcacggtaacgtcagagcttgcgaataccgatttgttagaagaggtgggaggcgtctcttacctgacggacatcgcgaattccgttccgacagcggctaatatagaatattacgcgaaaatcgttgaggaaaaatccattctccgccgtttaatcagaacggcgacctcaatcgctcaagacgggtatacgcgcgaggatgaagttgaagatttattaagcgatgcggaaaaaacgattatggaggtcgcgcagcgaaaaaattcgggcgccttccaaaatatcaaagacgtgcttgtgcaaacatacgacaacatagagcagcttcacaaccggaaaggcgatattaccgggattccgactggttttattgagcttgaccggatgacggcggggtttcagcggaatgatttgatcattgtcgcggcccgtccgtctgtggggaaaacggcattcgccttaaatattgcgcaaaacgtggccaccaaaacggatgagagcgtcgcgatattcagtcttgagatgggtgccgagcagcttgtcatgcgtatgctctgcgctgaagggaatattaatgcccaaaatctcagaacgggaaatctgacggaagaagattggggcaagctgacgatggcgatgggaagcctgtcaaacagcggtatctttatagatgacacccccggcatccgcgtcagcgaaatccgttcaaaatgccgcagactgaagcaggagaacggattgggcatgattttaattgactacttgcagctcattcagggaagcggccgttcaagcgacaaccgccagcaagaggtatcggaaatttcacgggcgctaaaagcgctggcgcgggagcttgaagtcccggtcatcgccctgtctcagctctcccggggtgttgagcagcggcaggataaacgtccgatgatgtcagatatccgtgagtcgggaagtattgagcaggatgccgacatcgtcgccttcctgtatcgtgatgattactatgataaagaatccgaaaacaaaaacatcatcgaaatcattattgccaaacagcgtaacggcccggtgggcaccgtctcactggcttttgtgaaagaatacaataagttcgtaaacctggaaaggcgctttgatgacggcggtgttccggcaggtgcgtaaagcctcaagcaatgtcttgaggctttttttcatccgaaagaatgagagaatgccgtccgttcggcagacgaaaaaaagaaagcgcttttatataatggcattaagggaggaatgatgatgacaattgaatttccgcaatttcaagcggcgcaaatccggattgcccggccgaccggacagctcaaagaaatcatcaggttttatgaagagggactcgggctgaagagggtcggcagtttttccggacatgagggctacagcggcgtcatgttcggcctgccccatacgcaatatcacttagaattcaccgaagaaaccggcgcgtctcagccggcgcccgttccgcacggcgacagcctgcttgtcttttacatccaggatcagcaggaggtcatccgcatcagcacgaaattaaagcagatgggatatgaggagaaagcacccgaaaacccgtactgggaagaaaaaggcgtgaccatcgaagatcctgacggctggcgggtcgtcctgatgaatacaagtggcatataaatgactgtctgaagaaccctgattacgggttctttttcttgttaaagcatgaaagtttcgggagtaatagatagcaaatgaaagagaaaacgcttttaatcatgtttaaggcgaacaaatatagattgataagatttaaatgttcggatttacgattgactttctgtttcggcactgatacacttaatttgtttgaatgagatatcgttttgaaaggttaacggaggtgcacggatatatgtcttcagtagtcgtagtaggtacgcagtggggcgatgaaggaaaaggtaaaattacagatttcctatcagaaaatgcagaagtgatcgcacgttatcaaggcggaaacaatgcaggacataccatcaagtttgatggcgtcacgtacaagcttcatttaatcccatcaggaattttttataaagaaaaagcgtgtgtcatcgggaacggaatggttgttgatccgaaagcgctcgtaacggagcttgcgtatcttcatgaacgcaatgtgagcacggataacttgagaatcagcaacagagcccacgtcattcttccataccatctgaaactggatgaagtagaggaagaacgcaaaggggccaataagatcggcacaacgaaaaaaggcatcggacctgcttatatggacaaagcggcgcggatcggcatccggatcgcagacctgttagatcgtgatgtgtttgcagaaaagcttgaacggaaccttgaagagaaaaaccgtctgcttgaaaaaatgtatgaaacggaaggcttcaaaattgaagatattctggatgagtattatgaatacggccagcagattaaaaagtatgtatgcgatacatccgtcgtcttaaatgacgcgctggatgaaggccgccgcgttttatttgaaggcgctcaaggggttatgcttgatatcgaccaagggacatacccgtttgtcacttcatccaacccggtcgccggaggggtgacgatcggttcaggcgtaggcccgacaaaaatccagcacgtcgtcggtgtatctaaagcgtacacaacccgtgtcggtgacggtcctttcccgactgagctgaaagatgaaatcggggatcaaatccgtgaagtcggacgcgaatacggcacaacgacaggccgtccgcgccgtgtcggctggtttgacagcgttgttgtccgccatgcccgccgcgtcagcggaatcacagatctttctctgaactcaatcgatgtgctgactggcattgaaacattgaaaatctgtgtcgcttaccgctacaaaggtgaagtgattgaagaattcccggcaagtctgaaagctctcgcagagtgtgaaccggtatatgaagaaatgcctggctggacggaagatatcacaggcgcaaaaacattaagcgatcttcctgaaaatgcgcgccattatctggaacgcgtatctcagctgacaggtattccgctttctattttctctgtcggtcccgaccgttcacaaacgaacgtcatccgcagtgtataccgcgctaactaagaatttgcagcaaacaagcctccggtcacggaggcttgtttttttatgtaggaaaaaaataatagatttttttcaaaaaagtagttgccactttcgaatgttctatgatattataaatctcgttgttacggaacagcttcaatagagtactgcaagaaagcttttgtctgaatgctctatgatacataatccgacacatcaggagccattagctcagttggtagagcatctgacttttaatcagagggtcgaaggttcgagtccttcatggctcaccactttttatggcccgttggtcaagcggttaagacaccgccctttcacggcggtaacacgggttcgaatcccgtacgggtcattgatttactttagcgttattgctaactccttatttgtcctcggagggccgccacgatacggctctccggacaaattactgtaaggtccggtagttcagttggttagaatgcctgcctgtcacgcaggaggtcgcgggttcgagtcccgtccggaccgccattttactttactttatagtatagaaaagaaacatctggctcggtagctcagttggtagagcaacggactgaaaatccgtgtgtcggcggttcgattccgtcccgagccacttacccaaacgcatctgcaatagtaggtgcgttttttcttttgttataaaaaaagggagagccggcttttcagccggcccagaagaagacgtcaaacactagacggcgttttttttcgtgaggtttcaaaaaaatattatttaaaagaaaataaaaaacatgacaaaaggatggcagttcaatacgtttttgcgctgttctctttaatttttttatcttttgacctgaaaccgttataatagacggggaacgtttttcacgatccgaattgtgatcatcatgaaacatcaatagatgaaatgaagtcattctggcaggaggaaaatcaagatgatggataagaaaatccttgtagtcgatgatgaaaaaccgattgcagatatattagagtttaatttaagaaaagaaggctatgacgtgcattgtgcgtacgacggaaacgaagccgtggaaatggtggaggagcttcagcctgatttaattcttttagatattatgcttccgaataaagacggagttgaagtgtgccgggaagtccggaaaaaatatgatatgccgattattatgctgacggcaaaagactcggagattgacaaggtcatcgggcttgaaatcggagcggatgactatgtcacgaagcctttcagcacgcgtgagcttctggcccgcgtcaaagcgaacctgcgccgccagcttacggttgcgccggctgaggaagaatcagcttctaatgacattcatatcggttctctcgtcatcttccctgacgcttatgtcgtatcaaaaagagaagaaacgatcgagctgactcatcgtgagtttgaattgcttcattacttagccaaacatatcggacaggttatgacgcgtgagcatctgctgcagactgtgtggggctatgactatttcggtgatgtgagaacggtggatgtaacagtgcgccgtctccgtgagaaaatcgaggataatccgagccatccgaactggatcgtcacaagacggggtgtcggttattacttgagaaaccctgaacaggactaaccggcgatgaataaggttggtttttttcggtcgattcagtttaagatcacgctgatctatgtgcttctcattatcatcgccatgcagattatcggcgtgtactttgtgaaacaggtggagaattctcttctcaagtcctatgaattatcgttaaatcagcggattgacaatctttcctattatattgagcaggaatataaaggagataatgacagcaccgtcattaaagatgacgtcaaacggattttgaatgattttacgaagaataatgaaatacgggagattacatttgttgataaaagctatgaggtcgtcggttcctcgaggccttatggcgaggaaatagcggggaaacagacgactgacccgatttttaaacggattttctcaacaaaacaggcctattcaaaaaaatattatgatcctaaaagcaaaaacagagtgctgatttcagcaaaacctgtcgtcacagagaatcaggaagttgtcggcgcgatatatgtcgtggccagtatggaagatacctttaaccagatgaaaaccgtcaactcgattcttgcttcaggaacaggcttagcccttgttctgacggctcttctcggtatatttctcgcccgcaccattacccatccgctgtcggatatgcgtaagcaggcgatggaactggcaaaagggaatttctccagaaaggtgcggaaatacgggcatgatgaaatcggtcagctcgcaacgacgttcaaccatctgacgagagagcttgaagatgcccaagccatgacggaaggggagagaagaaagctttcttccgttatcgcgtatatgacggacggtgtcatcgcaacgaatcgcaatggagctattattcttttaaacagccctgcgcttgagctgctgaatgtttcacgtgaaacggctttagagatgccgattacgtctttattgggcataaaagagaactttacatttgaggatttagtagaacagcaggattcaatgctgctggagatcgaacgtgacgatgaaacgactgtactgcgggtgaatttttccgttattcagagagagcacggaaaaatcgacggtttaatcgcggttctttatgatgtcaccgaacaggaaaaactcgatcgggaacgcagagagttcgttgccaacgtgtctcatgagctgcggacaccgctgacgaccatgcgaagctatttagaggcgcttgcagaaggcgcgtgggaaaataaagatatcgctccgcgtttcctaatggtgacccaaaatgagactgagcgcatgatcagattggtgaacgacctgcttcagctttctaaattcgacagcaaagattatcagtttaatcgagagtggattcatatgatccgctttatgtcactgattatcgatcgttttgaaatgacaaaagaacagcatgtcgaatttatccgcgagctgccggacagaaatctgtacgtggagattgatcaggataaagtgacgcaggttctcgataatatcatttctaacgcactgaaatactcaccggaaggcggacatgtcactttctcagtcgatgtgaatgagaaagaagagctgctttatatcagcgtaaaagatgaaggtatcggcattccgaaaaaagatgtggaaaaagtctttgaccgtttctacagagtggataaagcgcgcacgagaaaactcggcggcaccggactcggccttgcgattgcaaaagagatggttcaggcgcacggcggagacatttgggccgacagtgtagaaggcaaaggaacgaagattacatttactcttccatataaagaagagcaagaggatgattgggatgaggcgtgaaaatataaaaacagtcatactgtcagtgctggtcgtcattagtcttgttttaacatggggaatttggacattccagcccaatttttcagaaggcacggcctcaaccaaatcgactgtccgggaaaagcataaaattgataaaacgagccaaaaagtgtcgcaaacggtaaaaccccgggatatgtttattcatacaaacggctctcattacaaagtggatgatgagacgctctttaatgacctgtgggcggatttgccgcaatgggaagtaaaagggatgaaggatatttccgatcaatacgacaagctcggttttaaaaattggctttacggcagaaacggcaattcggcaaagctcgatctgcaattcaatgacaccattccgattgatttcttccaaacgatgtttaaatggtcgaatccgtcaatggaatacagctcatttgaccatattgtcattccgtttaatgagaataagacgaataagaagatttacatggtctcgtacagtaagcagctgattttggaagtgactgtggaatcggcgaattaccgcaatctgatgaatgagctgtacagcaaaaagtcgagtatgccgttataccacctctattcggtcggaaaaagcaaagaatttctcatgccgaatgcgcggtttaatatgaaggaaaaagaatttatcactgaaaccattaagacgaacctgtttaagcagacgctttttaatgatccgagcacggtcagagaagacccgaattacaatcggaatgtgctgactgacggaatcagccgtctggaaatcaattcgacacagcggcagattcaattccagcatcggaacctggcacaaagcgcttcttaccaaacgggtgagctgattaagaaaagctataaatatttagaggatacgggaagctggacggatcattatcaatttttcaatgtgagtgataaccagcagctgagtttctacatgtttaaagaccaaatgcctgtgatcaacagcacgtctaagcctttcggatccggacctgttttgaccctgcaatgggccaatgacgaggttctcagctacaagcggccgaactatgttctcggaccgaatccgattaaaacaaaagacgtgaaaatgatgagcggcaatgaggttgtgtctttgctggagcagcaggttaaatacgacgtgaataaaatcgaccagatcttcctgtcctatcaaatggtatcttcgtcaacgaatgatcttgttgaactggaacccgtctggagtatgaaaatcaacgggaagatcgtcccgattacgaaagatctgctggggaaggaggaggacgataatggagtggaataagacaaaaacgatcttcatcattgccttcctcatcctcgatatttttctcggctatcagttttttgaaaaacgctcgagcagtgaatacgaagtgattaaaaattcaaatgtggaaaaagacatggagatggatcacatcacattcggaaacctgtcttctgattccgcgacgggctaccggctgacggcgggccaaaaggtatttaccgctgaagatattgatgctttgaaggatcaaaagccgttaatggagatgccggcggatgatcacaaggtcacaacgctgaaaatgaaatttaccgatccggtcggtttatcaaagcaaaaaccgcaggaggatgcggaatcgctcgtcagctctaaagtaaccggcggtgaaaaatataaactgtggaaagtcgacaaggatcaaaaacagatcattttttaccagacgtatgacggacagtttatttatcaggattttgactcgtccacggatgcgatcggacaggtgattctgcatctgaacgataaaaacgaggtcgtatcttacgagcagaccatgctggagtcattcaagcgaatccagacggagagcctgattcctgagcttgatgcggtcgaattattgtattctcaaaattacttaaaagcgaattgcgccgttaaaagcgttaagttcggctatattgcccaatatccgctgacaagtacgcaggtgctggcgccggtatggagaattacaattgaagataagtcaaaagggacgaagaaaaagacacagcaaacgtacactgtgaatgcattggaaagcacagtcattgataacaatcaaaataaataatggagtgagacacaatgggcttgcaatttagcgtgcttgcgagcgggagtaccggaaacgcgttttatctggagacagaggagcactcttttctggtggatgccggcctgagcggtaaagcgatggacgggctgatggagaaaatcggccgcaagatagacgacgtggacggcatctttgtcactcacgagcacagcgaccatattaaagggctcggcgtcattgcgagaaagtacggtcttcccgtctacgccaatgaaaagacgtggaaagcgatggagaatcagatcggcaagctggataccggacaaaagtttctgttcccgatggaaagcgtaaaatccttcggcgggcttgatgttgagtcattcggcgtctctcatgacgcggccgagccgatgttttatgttttccactaccaaggcagaaagctcgcactgatgacggacacagggtatgtgagcgacagaatgaaaggcattatccgttcggccaatgtgtttgtgtttgaaagcaaccatgatgtcggcatgctgcaaatgggcagatacccatggagcattaagcggcggattttaagcgatgtcggccacgtctccaatgaagatgcggcgctcgccatgactgatgtcatcggcgacggcacatcgcgcatctatttggcgcatctgagccaagacaacaatatgaaggaactggcgagaatgtccgtgcagcagacattggctgcgaaaggatttgtcgccggggaaacgtttcagttatgtgataccgatccgaaaatcccgacgccgctgtgcgccgtgtaatttttccaaatgaatcatgattattaatccgcgatctgacccacactataagcaaatcgagtactcttgaaaggatttgagatagggtggattataatcgcgatgatgaacagtacgcctccgaacagccccgccgcagcaagagagggtactttctatcaagtctgatcggcgtcatcgtcggggccgcgctcatggctttcctgctgccgtactggacaggcggagaccatggagaaagcagcaaaagcaccagccagcgtctcggcaacgaacaggtgaaaacagtcaacgtaaatgtcaatgacgctgtcacgaatatggtcagccgtgtatcagattcggtagtcggcgttctcaatatccaaaagaccgatatttggggagagggcggcgaagcgggaagcgggtcgggcgtcatttacaaaaagaacggaaacacttcttatatcgtaaccaatcaccatgtcattgaaggtgcgactgagattgagatcagcctgaaggatggctcacgcgtgcctgctgaactaatcgggagcgaccgtttgatggatctcgccgtgctgaaggtgaagtctgataaaatcaaatcggccgctcagttcggcaattctgatcaggtcaaagtcggagaaccggtcattgcgatcggaaatccgctcgggcttgaatttgcgggatcagtgacacaggggatcatttcaggcacggaaagggcggtgcccgttgactcaaacggcgacggacatccggattggaatgcggaagtgctgcagaccgatgccgcgattaatcccggcaacagcggcggcgctttgatggatatatcgggcaaggtggtcggcatcaactcaatgaagatcgctgaatccgccgttgaaggaatcggcctgtccatcccgtcaaagcttgtcattcccgttattcaggatttagaaaaatacggagaagtcagacggcctttcctcggtattgagatgaaatccttaacggatattgcgagctaccattggagccagacgctgaaacttccgaaaggcattaaaaccggggcggtcattatgggtgtcgacgcgttttcaccggccggaaaagcgggtttgaaaaagctcgacgtgattaccgggttcgacggacataaggtcaatgacgttgtggatctccgtgagcgcctgtatcgcaaaaagatcggtgaccgtgtgaacatcacgttctaccgttcgggaaagaaaaaaacagcggaagtcaaactgacagaagcggatcgattacagaaataaaaaacagcccggacatccgggctgttttttattgatttatttgttaatattatactattatgaaaacgggaggtgacacacatgaaaacggctgatgtgatcatcgtattgaatgaaattgaaggtgaatgtgaaggaagaattattttagaatgcagaatttaagaacatgaaacatgtcatatcaaacgtcctttttcagggcgctttttttatgccttttttcagaagccataaaaaaagaactgaacgcgggtcacaacacgttcagttaaaaatgggtatatttagaaaaaggcagacatgaacttagaactggtgctgctgaattgaagcggcagataatgatttttatttgcagattgctccgttttcagcgtttcctttcaccaattcagcttagattccgttttgtttcagataaaagcgaataatagaaggggaagcgaaaaaaataaacacaggctgatacatctaaggagagactgcatcatggaaaagttgaaaggcatcaagctgagtgcagacggcgagtctgcgctcattgattctttaacgatggggcttcattacggaacggtcctcggggaagacaatatcgtcgaggtgtacatccgttctttgcgcgaaaagctgaaggataaagaacacaaggtgattcgcacggttcggggcgccgggtacaggatgaatctggcatgaaacggctgtacagaaccctgcggttccagctcctgttcaggtcactggcgattttggctttgctgttatgtttcatcggcggtactcagtacatgtttatgacacggacgatgtatgaaaatcaggcgatcagcattcagagtgatatcaattcaatggatcaaagcgtatggaggtcaatcaaaacccttgcccgttccgaaacaccggctcatccgaatttgatttaccccggggtgacggttgcttttatcaatcaatcatacaagatgtctgttttatcagaagacccgcacgcgggggccgctccttctttcccgaaaaaagtgtacagggatgcgctgacagacaccatggcgcttcactatcaggtggctcacaatgaggcgggtgaggaaatcatcgtcgtgtttcaggcgatttccgttgacggaaggcaggcgggagttgtgcagatgagcacgctgacacagcctttgaatgattcgcttttccgccagatcagcattttcgcggtgctttcctttgcggctttggtcatcggactgtttgttttcttgccggtgatccggctcacactcaagccgctgtcccgcattgtgcgtatgatgggtgacatttctgccggcagtctcgataaacggctgccgatcgataggaagcaggccgaaattgagtcgctgggcatctccatcaatcagatgctggaacggattgaaacctcttttcaggcggaaaaagaagagaaggaacgaatccggcagtttgtatcagacgcatcgcatgagctgagaacgccgcttacctccattcacggctgtatcgaaatgttaatgcgcggagcggcggagaagccggagcagaaagaaaaagcgcttcaaagcatgtacacggaatccgccagggcgaataagctgatagaggatcttctgtttctcgcgaagattgaccgggtgccgagctttgaaatgaaaaaaggcgcattgggagacgtcattttggaaatggaggctcagctgaagctgctcgcgagaaaccggaagctcgagttctttgtcgatcaaaagatagaagccgtttttgacaaagacaaaatgaagcaggccattctcaacctcttttacaatgcggtgcagcatacggatgaagacacgggtgtcatcaccgtctccctgcagaaagacggaggaatcatgcttatgattgcggataacggaacgggaatcgctccggagcatgtgcctcatttgtttgaccggttttacagggcggaaacctcccgatcccgtcaatccggcggcgcggggctgggtcttgccattacaaaaaccattatcgacagtcacaacggaacaattgaagtgaaaagtgagcagggaaaaggctccgtgttcatcatccggctgccgggataaaccgggaagcaggaagaaatatcacaatttatatgtaaattctaaattttcaaaaaataacttgtccttttccaatattggtgataatatctagttattggtaaagggggtgtgtactgatgaagattgaagaacttgatcttgatacagaaacagcaagcttggtgcatcgctgctagtaaagccgtgactcccctcattggggagttattatctttcagggggtatgtcatgatgtcaacggactgtaagcgctggaagtttaaagacagcgtgcaggtgctgacctacacggcgcatattatcattcaatatcgaaaggcgattaagcttgcgcatacgagtgagatcaaagaggcggttgaacggctgatcatcggctgtgaaaaacaagagctttctgatcttctgggagaggaagcgggaaaccagtttttcgatgctttaatgaaattggatgctttaatagagccatggcaaaacggccgtgaaggccgcatcactgaaaagcagctgtaccattttgagaaatacaaccaaaaccccaatctgatccaaaagagattagacggcagcagggcagcgatcgtgggtctggggggcgtcggaacgatcattcttcaaaaccttttggcggcgggcatgcagcattttattctcattgatttcgatgccgtatcagtacataacctgaacagacaattcgtctataataaatcttctgtaggcaaattaaagatctcagaatgcagagattatattgcgggtatcaatccccatgcggacgcagcactttaccataaggaaattacacagccgcaggacctgcgtgtgttagatccgtacgaaattgatatcgtcataaatgccgctgacaaaccccataacatttctgaatgggtttaccggtattgtaaggagcggaatattgcatttatgaccgggggtgtcggcagcttcagcggccaatgggggcctctgctcacgcctgaatcctatcaatccggcgtcacctatgaaaaaaacatgtcggccggacttctgaactgttaccccgatgaaccgatcaaaggttccttaggagcgacaaacggtattatatcctcgtttatgtctcatgacattatcacataccttgcaggcggaagcccgaaatccctgaatacccgcatcggcctggactttgacggccttcatattacagaaacgaagctttctcaaaaggaaagcgctttatgaagacgatgcatcgtacggcgagaaaaccgggcgaccctctgaaaatagaaattgacacaagcccgatacgcttgaacccattagatacgcaggattacacaagcaagatgatttgcagcattatgtatgaaagcctgcaggacggctataactgccggatcatccgcaaagatccccgcacctgtcaggtggacattcacccggactatttaggtgacgccgagggtgtgattcaaacgatcatctatcatctgacgaaagaaaatcaaagcccccatctcggcagtttcctgaacataaaacaggccgttccgtatgtaaaaggcctcgtctcttccgatcagctcggggtgaacgtaacgggcgaaaaacgctttgaagtcaccttggacgagccgtctgatgaaatagaagccgttttgcagagcagctttctgattcctgggaccgccgggggcgatgtgccggaaaacggcccgtaccgattcaagcgcacgtttgagaaggggctggaatttgagcggaatccgcaatataaaatgacgcccgcggatcaccgcacggttcagaccatccaatttattttgaatgatgatctggaaaagagcatcgggctgtacgaagcgaatcaaacggacgtgacctgccacacccagtttcatcattcaaacatgaggtatcggcagtatgctgattttaaagaaaatcatttgccgatgttatttaccttcaaggtaaaggacgacatgctgagaactttcattcagcattattttgataaacaaaagctggccggggatttggggcatatcatcacaccgactgattcactgatcggtatatgggaaagcgggaggacaccgcagaaagatccgccccttttgacaagagaagaaccgatccgaatcgtttatgccgattattatcccaacggagagatcattgaaaggctggctgatttgtttcgacgggccggagcggacgtgtccgtctcccgcgtcagtcatttcaatgattattaccatatggataaaagccggtttgatattgagctccatttgttcctgccggcttacatgcatgagctgagctatatcaaatatttcatccgcgacatcagcgatccagggaagaaaaaaacgatcattgatgccgtaggatctgaaaaaaagaaggaactttttgggttattcgagaatacaactcattattgcccaatttgttttgggaaaagtctgtatctgcaagatccatgtatagagggttttagtgtaaagactgacgggctcctttctgttcatgatgttaaatgcagatagctggaaaggggtattcatttgcggaatcgaaatttgctttacttctccggttttttcggaaacttctttttcgaacggggaatttggattttatatttaacaagcatgaattattcattgtttctagtgggcatcctgcaatcggtcctgaatttggcgatgtttctggcggaagtgccgagcggcgtcatctcggacagaatcgggagaaaaaaatcgctcttgctcggccattttatggtcattgtctatttggtgatgttcctgagctttcataacttcatcgccctcttcatcgcccatattatatacggtatcgggctgacgtttatatcaggaacggatcacgcctttttgtttgattcactgaaagaacaagggaaagaaaaatggtacggcaaatccatcggaaactataacggacttgtcatactcggtcttgcgatcgccatgggcatcggcggctacttgcaggaaatatcatggtcgtatgtgtttatcgccgggattgtcactcagctgattgcaatggcggtcattacacagctgacggaaattaaatttgaaaacagtgaacacgaaacgcagacggtcggtgacatcttaaaagaagtcaaagatttcttcaggctgaacaaagcctttaaatatctggtgctgtcactctccgttttctttgcgattacatcggttttttatatgtacggacaagatctgttaagtcaggaagggctgtccgtgcgcaatatatccattatttttgcgggactgtccatcttgcaggcgctgtgctccatcttttcttccaagccggcggaaaaattcacgccgaggcgcgtgcttctgctgacattctgtatcatcggggcggcctacctgtttataccttcgggcagtctgtacgtgacgattgcagcttttgtcgtcattaacgcgctctatgatgtgatagaacccgtatccagtcaggtggtgaataatgagattccgtccagaacgagagccacgctgctgtccattatcagtttgatgacctcgctcttcatgttcattgcctttccgtttatcggattcttaacggactattttgattcagctttgctgctgaccgcaatcggggtattatccatcttattgtcgctgtttatgatgctcagcttttacaaactgaaagcgagcgtcgccatccagaataaagtcgagctttgaaccagaatgacaaagggatgatgtgagttgctgaatattcataatcttacggtaaatttagcgggagataccattttcaaacaagtttcttttttcatcaatgaaggcgaaaaagtacttgtggccgggccgaacggttccggcaaaagcacgctgttcagggtgctttccggggagcttgaggcagatgaaggaacgattgcgatcaacaaaggggcgaaggtcggtttgctgaagcagatcgctgatccccatgaagatctgacgttgtatcaatatctggaaaaatcatttgaagctctcgcggcgatccagaatgaaatgaaggccattgagctgaagctttcggaaccgatgagtgatgacgagctgactgctttattggaaaaatacagtcaatacacggaaacatttgagcggaacaacggctaccagatgcatgcgatgattgacgaggtatgcaacgggctcagcctcagcgaattaaaggatcagccgttttcaaagctgagcggcggcgaaaaaacaaaagccggccttgccgaaattttaatccgcaaagacgacgttatactgctggacgagccgaccaaccatttggatgtccatgcgattgagtggcttgaagggtttattaaaaaatcgaacaaaaccattctgtttacgacccacgataaaacgtttgccgaccaaacggcgatgaaggtgctcgagattgacgataccgaggtgaagatttggccttacggattcagcgaatacttgaaaaagcgggaagaattcatcatcgcccagtttgagaaatatgaagaacagcagagaaaaatacagaagatgaaggaatccatcgcccagctgagagattgggccaaccgctcaaatccgccgtctgtcggcctgcacagacgcgcgaataatatggaaaaggcactgaaaaggatcgagctgatcaataagccggtccggacggagcaaaaattaaaaaacgcatttcaggaagcgggcgccggttcaaaagatattgtgttcattgaaaacggaaaggtgaccaacggatcttcccttttatatcaaaatgtgaatctgcgcataaagcataaagacagaatcggcatcgtcggcagaaacggcgtcggcaaaacaacgctgatccgctgcatcatcggggaaaaagaactgtcggacggcaccattaaagtgggagaaaatcttaagataggctacattgatcaaaagagccacgtcggagattcgagtcagacgattctgcaattttttaaagaaaatctgctgactgaagagggcatggcccggaatatgctggccaagtacggattttacgggtcgtcggtctttaaaaaactttccgtcctgtcgggcggtgagagaatcaggctgaagctgtccatcttaatggaaaaaaagctgaatgtcctgatcctggatgagccgaccaaccacttggatattgaatctcaggaaattctcgaaaacagcctgatgcagtttcaaggcaccatcatctgcgtttctcacgacagaaacctgctggagaagttcaacaagattttctggcttgagaatcaaaacgtcaccatcttttcaggtccatacagttacgccaaacaaaaaaaacggcagattgccgaataaaaggggaatggatatgaccattgacagactgacaatcaatgagttatcgtacgatctttttgtaagcgagtatgctgataagaaaccttttattttgacgggggcaatggatcactgggaatgcagaccgtggacgcttgaatacattgacgaacactatggggacagaatggtcaccatccggaaatcagatatcgaaggggtcaaaacgtttaaacaagtaaagctttccaactatatcgagtacattgatcagaatgatgacaaatggtactgtgactggaactttacgcagctgaaccaaaatgacttagaccttgtctattccgcacccgagtattttacaaaagacacattgagagcggatgaagaaacgggacgggactggaaatggttctttctcggttctaagcagacaggcacgccgctgcatcaggattttaacaacacgcacgcgtggaacggcgtcattttcggggagaaggaatggatcttctatcatccggacgactctccgtatttgtacgaaggaaatatcaatgtctttgatgaaaaagacattgagcaaaaaccgctggtgcaaaaggcgtctccgctccgcttcagacaaaaggcgggagaaatcatttacgcgccgcgccgttggtggcatcaagtcgagaatacggaacatacattggcagtgagtgagaacttttggtttaccggagagcggcttgccaatcagatataacctgacgaaaggctgaggagcatctcagcctttttttgtatggattcatttcatccggtccagaccgaattttttcaggcggtattgcaggctctgtctgctgattccgagctcgtttgccgttttggatatgttattgccgtgttttctcaggatcttttcgatcatgtatttttcgaagttttccattttgtcttttaaatcggtgccgggctgggtgcttgcggcggctttggtttccgtgtcagccggtttgattttcatccggtattggtaaggcaggtgggccgccgtaatcgtcgtttcatccgtcataaagttcatggcgccttcaatcatatgttcaagctcgcggatgttgcccggccagtcatattccaggaagaatcgctgcacatcgtcactgatcgaatcgacatgcatttggaacaggtgattgtttttctggataaagacttcggccagaggcagaatgtcctccttgcgctcccggagcgggggaatgatcagtgtgacaacgcttaagcggtagtataaatctttgcgcagccgctcttccgaaatggcggtgatcgggtcttcattcatcgtggcgatgatacggacgtcaatcggtttgtcctgcgctgatccgatgcgcctgattttcttttcctgaagggcgcggagcagttttgcctgcaggctgagattgagcgagttgatctcatcaaggagcagggtgcctccctgcgcctgctcaaataagccgggctggtcgatggctccggtaaaggcgccttttttcgtgccgaataaaatactttcgaccaggctatccggcagggcggcgcagttttgtgagatgaacggggcgcctgagcgctggctgccgttgtgaatgctttgggcgaacagttccttgcccgttcccgtctcgccggccaaaagcaccgatgatgatgtgcgggttgcccgtttcgcgttttcgatgacttcccgaatgaccgggctgttgccgagaatactgtcaaacgtgtagctgttctgttctttcctgtgcatgttctccctgatcagccgttcgagcttggtgacgtccttggcgatttccacggctcccttgatctcgccgttttgcacaatcgggaaagtgtggttgatcgtcgtgatttcctggcctttgttattgaaatagctttgctttacgtttttaatcgttttgccttcttgaagggcctgaacgagcgtgctgtcctgctgattggaaaacataaatacatcagtcaggtttttatgcaggacgtcccgttcatccatatcttcaatctgcatcattttcttattgtaaatgacggtgctgcccttttcgtccaccacatgcagcccgacatcaatctcttccagaatgctttgtaacacgagtgtgtaaaattcgctggttgtgtgcaggtcaattccccctcccaatcgtcttaacattcattattttaaaataaatcgaacgggaaacgcaaaaaaattttgcgcttggacgatgtttaaaaataaatggaaattaaggtaataaaaccattgacttttttaaggaaatggttgatatttagatatatacttaaatatctaaattatgtatgtatgagagggggaaagtttttgaataaagcttttaaagcactggccgatcctacaaggagaagaattttggatttattaaagaaacaagacatgacggctggtgaaattgcggaacacttcgacatgtcaaaacccagtatttctcatcaccttaccatattgaaaaatactgatttggttcacgatgagaggaaaggccaatttattatgtattcattaaataccactgtattacaggatcttataggctggttcttttctctgactgattcagaacatgataataagaaaggcggggaatcatgaaaaaatatctcttttcggcaggaatcatagttttaactgttttcacatgggtttgcacatattcatctttaccggacaatttggcgacacactggggattaaacggaagtgcaaatgattaccaaacgaaagctaatgcgatgatgatgcttattggcatcatgattattctatatattttaatggttatcatccctaagattgatcctaaaaataactacaaaacatttatccggccatatatggctatatttaatacaatgtttgcggttctgtttgtcattaatctgattaccatcttgaccggtctgggatatgatctccctatatcttatttaggaaactttatagtgggagtcattttcatggtgtttggaaacttcattcagatcgttaagcctaatttctttttagggataagaacaccttggacgctgagcagtgaaagcgtttggaaggatacacacagggttagttcgaaactttttgtcttagcgggcatgctcatgatgcttgcagcttttttgccgccggtgtatagagtgtcagtcattttcatggctgcaatcggctgtatcatattatctttactatattcttacattgtatatcagagacaattgaataaataactgttgagtaggagcaatctaattggattgctcctattttgtcagcgggaaacgcaaaaaaattttgcgcttggctgaagtttgcacacaaactgccggaaaattttgcgggaaaagaaagaatgttggcgaaacatcccgttttttcggattggcacggaacttgctttataaaaagggaaagcaagatctaatgttgaatgattacaaaacaagggggaatcagattatgtcagctttcacaaaatctcaagaaattatcagccaaacttcacattacggcgcgaacaactatcatcctctgccgattgttatttctgaagcgcagggtgtttgggtaaaagaccctgaaggcaatcaatatatggatatgctgagtgcttattctgcggtgaaccaggggcacagacatccgaagatcattcaggcgctgaaggatcaggcggataaaatcactctgacgtcacgcgcgttccataatgatcagctcggtccgttttatgagaaaacagccaagctgaccggaaaagatatgattctgccgatgaatacgggggcggaagccgttgaatccgctgtcaaagcggcgagacgctgggcatatgaggtcaaaggagtagcggataatcaggcggaaatcattgcgtgtatcggcaacttccacggcagaacgatgcttgcggtatccctttcttcagaagatgagtataaacgcggtttcggacctatgcttccgggtataaaattaattccatacggagacgcagaagcgctgcgccgggcgatcacgccgaacacagccgctttcttattcgaaccgattcagggagaagcgggcatcgtcattccgccggaaggatttttacaagaagcggccgccatttgtaaggaagaaaatgtgcttctgatcgctgatgaaattcagacgggactcggccgcacagggaaaacattcgcggttgactgggaaaatatcgtaccggatatgttcatcttaggcaaagcgctcggcgggggcgtcttcccgatttcttgcatcgcggcgaaccgtgacattctcggcgtgtttaacccgggttcccacggctcgacattcggcggaaacccgctcgcttgcgcggtatcgctcgcatctcttgaagtccttgaggaagaagggctggcagagcgttcccttcagcttggccgttattttaaagaagagcttgagaaaatcgataacccgatcataaaagacgtgcgcggacgcggcctgtttatcggcgttgaactgacagaagcggcccgcccgtactgtgaaaagctgaaaggcgaagggcttttatgcaaagaaacacatgataccgtgatccgttttgcaccgccgttaatgatttccaaggaagacttggactgggcgatccaaaagatcacaaacgtgcttcaaaacgcgtaaaactttgatgcggcaatgctttccctcggcttgtatggaatttacaaataaaaaattcagcacactctatttgcgcggcgacagtattttagtataatgtatctttatgtacgaaaatgaatttaatataacattcatatacaaatagaggctctttggacagcaaatcggtttcaaagcaccggcttggttccaatacaagttgctgaaggggtgcagaatagtgaatacaaatcaaaaagagaatcagcttcagcgcacaatgaaatcacgccatttgtttatgatttctttgggcggagtgatcggcaccgggtttttcctgagtaccggatttacaattaaccaggcgggaccgctgggcgcggttctgtcttatctggtcggcggttttataatgtttttgacaatgctctgcttaggcgagcttgcggttgcccttcccgtatcagggtcgtttcagacgtacgcaaccaaattcatcagccccgctttcggtttcgcattcggctggctgtactggctcggctgggcggtgacatgcgccattgagtttttatctgcgggacaattgatgctccgctggtttccgcatgttcccgtatgggtgtggtgcctcgtgtttgtcggactgatgtttcttttgaacgctattaccacaaaagcgttcgctgagtcggaattttggttttccggtattaaaattttagtcattctgctgtttattattttgggcggcgccgccatgttcggcctgattgacatgaaacacggcgagcaggctcctttcttctctcatttttatgaggatggattgtttccgaacggcattaaggctatgcttattacgatgattaccgtaaacttcgcgttccagggaacggagctgatcggggttgccgcgggagaaagtgaaaatcccgagaaaacgattccgcgctctatccggcagacggtatggagaacgcttgtctttttcgttctctccatcatcgtcattgccgggatgattccgtggaggcaggcaggagtggtcgaaagcccgtttgtcgtggtgtttgaacaaatcggtattccatatgccgccgatattatgaactttgttatcttaattgcgctgctctcagtggccaactcaggcctgtttgcatcgacgcgtatcttatatgctatggcgaacgaaggacaagcctttaaatcgctcggcaaaataaataaacgcggcgtgccgatgaacgctctgatcgtgacgctggccgtcgcctgcctgtcactgctgtctaaagtggcagcgccggaaaccgtttatatgtttctcttatcattagccggactaagcgcgcaggtcggctggattacgatttccctgtcacagctgatgttcagacggagatacatccgcgaaggcggcaaagtggaagacctgaagtttaaaacaccgctgtacccggtgctgcctattatcgggctgacgttaaatacggttgttctgatcagcctcgcatttgattcagaacagcggctcgccctttattgcggcatcccgttcatggcggtgtgcgttatcgtctatcatctgtatgtaaaaaagcataagcagtcagaaaaacagatagagctttaaatcttttcgtgtccaagtcatctttgagaaacccgcacaggacaacatacaacatgttgaggtggaaaaacggatgaacaagaatatctcagttattggaatgccgatggatttaggacaagcacgacgcggagtggacatgggcccgagcgccatccgctacgcgcatctcattgaacggttatctgacatggggtatgcggtggaagacttaggcgacatccccgtcaatcgtgaaaaactcaaaaatgatgaagagctgaaaaatctgaactctgtgctctcggggaacgagcagctcgcccaaaaggtggacagcgtcattgagaatgagcggttccctctcgtcttgggcggcgatcacagcatcgcgatcggaacgctgacaggaacggcaaagcactataaacagctcggcgtcatctggtacgacgcgcacggcgacttaaacaccctggaaacatcgccgtcaggcaatattcacggaatgccgctggccgtcagcctcggcgtcgggcacgacacgctggtgaatctgggcgggtatgccccgaaaatcaagccggagaacgtcgtcatcatcggcgcgagatcgcttgatgaaggcgagcgtgagtacattaaggaaacaggcatgaaggtctatacgatgcatgagattgaccgcctcggcatgacaaaggtcattgaagaaaccattgactacttgtcagactgtgacggcgttcacctcagccttgacctcgacggccttgatccgagcgacgcgcccggcgtaggcacacctgtcgtcggcggcatcagctaccgtgaaagccacttggcaatggagatgctgtatgatgccgacatcatcacttcagctgaatttgtcgaagtcaacccgatcctcgatcacaaaaacaaaaccggcaaaacagcggtcgagctggtggaatctttgttaggaaaaaaactactataaaatatgcgcctccgcacctgcggaggtttttttgttgccacgaggaaactagcgggctgccaccctctttttgaacctgtaaatatgatatatttattacacaaaatgggaaagggaggtgtcctgacagatggctgaggtgatggcccacgaaacagttgcgaaaaaaatcagtgactggtatgaggaaatcaaaaagcacaacaccgaatcggctgaggcgttaagagaacaactgcttacggatctgcaaaatatgacacaaaatcaaacggtgctcctttattttaatttaattgattcccgctacaaacttttgatggaagagtatgagaaaacagacggcattttaaaaacgatccagctgaacgccgataaagaaaaaacagaccagatgattcaatactattattatttcttttccggaatgcacgagttttaccgtaaacggtttatgaacgccattaatttttaccggattgctgaaagcaggctccggcacataccgaatgagattgaaagagccgagtttaattatcaagtggcgattgcctactatgaaatccgccaaaactactttgcgatgaaccatgcggaaaaagcattagagatctacaaagccaatgaaatgtacgcggtcagagaagcacagtgtttaatggtgatcggctgtaacagaatggacttgtttcactatcagaaagccgaagagctcctgcagacggcggttcatcaagctgccaaagcgggcgatccgcatattaaggcgctcgcccactttaacgcaggtatttgctatgaaagacaggaaaagcttgaggaggcgcgggtcgagtttgaaacggctctcgatcaaaaggagcatttgcaatcagcgtattcggtgcggagtctgtacatgctggccagagtgttattgaaacaggaacaggcggatgagggccggttttggctgcataaagcgctgaatgccgctgaagaaaaaaacgagcccgtatacacccaaaagctgcgcatcttacagcatgtctttattgaccgcaatgaagaagcgcttgaatcagctttcgccgagttaagaaggaaagagctgtggagtgacgtttccgacttgtcgtatcaggccgcggcgcattttaaaaaacaggagaattacaaactggcggcgaagtattttcaagaatcaattgatgccaatgaccaaattttgagattaacggaggggattcgtaatgaaaacatgtaaattcattgtactctcagcagccttggcaagtctcatttcgattggattatttgcgcaaactggttcaacggcacaagccgaacaaatcataaaaccggcggaaaacggagccttcggataatacttcatgataccgctttcagtctgtgttttgtaaggagtgattcaatggctatcacgctgcagccgatgacaggacaagaatttcagtcctatctcgcccattcagccaagcattacgctgaagaaaaggtaaaagcgggaacgtggctgcctgacgaagcgccggagttagcggagctggcgtttgaagacctgcttcctgacggcttggagacggccgatcactatttatggacgctgacattggacggaaaggaaaatgccggctggctgtggctgcacgccgatccggaccacccgcagcaggacgcatttatttatgatttcggccttcatccgcctttccgcggcaaaggctatgcaaaagaggcgctcgcaaggctggaggacaaagccaaagacctgggtgttcgcaagatttctctccatgtgttcgctcataacgaaacggcgcggaagctgtatgagaagaccggatttctggagacggatgtcatcatgagcaaaaagctgtcatgaaaagaggcccgcacgatggggcctcttttgttattcatctaacaatgtcatcatgtgttccggataacgctcgccggccgccgtgccgatcggaaacatctcatccaaccgcgccttcacatcctcgggaagcacaatgtcgagagcggcgaggttctcttccaagtagtgtttcttttttgtacccggaatcggaataaggtcatcgccgtttgcaagaacccatgcgagcgcaagctgaggcgcggtgatattcatttcccgggcaatggcgttaagtttttggacgagccctatattcaccgccaaattgtctccctggaatctcggcgttcttcttctgtaatcatcggcatccagctgctcggtcgacgtcatctttccggaaagaaaacctctgccgagcggactgtaaggcacaaaggaaatgccgagctcacggcaggcgggcagcacatgctcctctgcttccctgctccataaagaatattccgattgaagcgcggcaatcgggtgaatgcggacggcgcgcctgatcgtttctgcggaagcctctgacaatccgatatacctcacctttccttcgtctatcagctccttcatggcgccgacagtttcttcaatcggcacccgcggatcaacccggtgcagatagtaaaggtcgatataatccgtcccgagacgtttcagactggcatcacacgcttttttcacataatcgggccgtccgttaatttcgataaactcacccttttcgcttcggacataaccgaatttcgtcgcgaggtaaagctcctttctgaatggggcgagtgctctgccgacaagctcttcatttgcacccaatccatattgatcagccgtatcaaacaaattcacgccgagatgaacggcatgatgcagggtggaaatcgactcttcctcactctggctgccgtagtattccgacatgcccatgcaccctaaccccattgcggaaacccgcatcgaaccgatcgttctgtccttcatatgtcctccccctttcttgtatgataaccggatttcctgatatttgaaaatggtttatgcatatgatttacatattgttataaaatttataaaaatctgtaaattatctatttttttatcgcaattctgtcatataatacaaatgtggaaaaattatactcaaagaaaagaggcgaagtaatatgtgtaaaaagctgttcaaagccgtcctcccgtttgccctgtcattcaccatggttctgtcgttctccggtttgaatgtaaaagcgaaagaaacagaagcagcccgctacgcaaaagaaatcgcagagcttcagcagggcacgactcctcaagacgttctccaatccgccaaagagcttgccaaacagaagcacgtttcaacagaagcaattctcaagcagtttcatcaagaaatcacggcagacaaggtgcagggaaatgtaatcgcttccaaagaagggttctctgcgatgggcggatcgtcaggaaccaaaaaacttccgaaaagcacaaaaggcaatatttattacacgaactcatacaccgcttattacaaccacgggcatgtcggcatgtattcatccgctgataaaattgttgaatctgtgccgggagacggcgtccgccagattgcttataacggcagagaagtcgaagacaattcaatcgttcagaccgtgaaagttaccgatgcccaaaaacaagccgccgctgactgggctgtatcaagagtcggtgatgagtactccttcaacttcgtcaataacagaaatacgggccatgaaggcgccaaaaactgctcaaaactgctgtggtcggcattcctcttaaaagccgggattgatatcgactctaatggcggcttaggcgtatacccgcgcgacatcacaagctcgtcctacacaaccacgattctgaccattcactaaggagaacaacgtgaaaaaaatcatttggatacccttagtgatcatcgccgccgcagcggttttatgcttcttctatttccgcacggaagaccctgcggaggttgcgagagacacattaaatgaccctgattttctgaaagataaagaggcgctgctgtacttctccactgcggctgaccaagacacgttcggcggcggaaaaagctacgccctcttcgccgatgaaaaaggacggctctcttcttatcacatgaaggggcttgagctcggatcggccaaagtgcatgacggcagcgtgctgctggaggacaaaaaaggaatctataccgttcaggacggccttcacacgtataaaagagcgtaccagcatacgggagacagcgcgggatatatcgagcgggcgaaaggcttttacacgctgtataattcgggctacgacaagagcggcggcagctatcgctcagagctgtaccgccagatggacggcaagtggaagcaagacgtcattccgcactatatccgcgcttcaggcttttttaaagatcatcttttcgcactcacgccgacagatgacgaaaaaggctatcacgtccaagacattcaggctgataaagagaagctccatacaaaatcaatcgcgacgtggacgtataaagaaggcacgtctgtcgaatcccagctcgtcgcggatgacagcgccgtctgctttgtcaccagaggggaaaaagcagaacacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcggcgcagcttctatttcgttgacggcttcggaaacgtgtaccgtatcaactctgagaccggaaaaagcaaaaaagccttcaagctccccgcatcacgaatgaaagccgacttcaaggagctgacccatcaaaacggaaagctgtatctgtttacgtacagctacaaaaagcctgccaaaatcgaatccttcgatctgaaaacgggcaaaaaactgaacggcctgaccatcccgggtctgaaagatatcgtgacgccgaaaagccatctcaagctgtatgatgtgcaggtgacggatgggtttgagaaggaaaagcagtcatcataatgaaaacacaaactttggattatataaacaaaaaaaccttttattggtttacctgtactcgtttgaggatatagagtagtagactgaataaaaggaggatatatagtgaaaaaacgtttcaaatggtttgtgggagtagttatttttgtttttatgttcagtttttcaggtgtgacagaagctattagtacaaagacaataaaagatgaaatcacatgccctgtctgtgataaaacgattaagtctgaaggaagtaaaaaagacagacaaaaagctttgaatatcgtcaaagacagagatgatttggatatagataaaacagaagtctttgtgactgttttaaataataaagatcataagattgcattggttcattatgaagatcagcaaaatcattcatttgcgcagaggtatattaatttaaacactgagcaaatcgttttatccgtagagggtataggaaaatgggacaaagaaaaaaaagaaggaaacttcaaattaagagttggcgataaagaaattattaatgaagattttaatcaagatggattaaaaggcaaggggaataatgctttattgaactctgtcaaaaaagcatctccgacaaaatcaaaattggagtcctgtaacgatttagtcacaaaaatgctggggctgggatccagtattgcttgcgcaggtgcttgtatggctgtcggaggtgctgtcggcgcagtagtgtgctcgcctttatgtttagcaattgaaaatggagttggcgaagcaggtgctaaagaaatttgtgaacaattctttggttgaaatatgcagatttgaaaagagcttgccgcttttggtaagctttttataatgaaacgttactgcaagaaagaaggtggtcatttgaaatcattcagtatcttcttattgttgtccgtcatttgcataaccattgtttttgtcataatgaatatgttgattggataccctgatgtgagtaacggggcagtgattatggttgtatatatcgttgtgaccctcttgataaggctatataacaagaaaaaagccgaccgaacatagagatagaggaatttaggagggagccgatgaagaaaaagcttgccgcggtgaccgtaaccattctcctggtttccgtaataaccaactcttttttaaacggcggaaagccggactggattgatgtttgctctacactgctggcgtgtctattaggaattctgttcgtccttcgcttagagaaaagagaaaacacgtaaagagccggatgctgaaaacaccggctctttttgcgcgtgatttgccgaattgtggataaaactcagcccgaagcactactaacatgtgtataaataggttatattgaaaagagaacaattgccgcgtgcaaaagaaaaccggaggacgtaacgatgaaaaccgcttattattcttgtgaagaacatatcgaaaccgtgctggacatgtacatagatgatcatgagcttccgcccgaaatcagaaaaatcgaacatactaacagtttatccacagcctgtgaattatgtggggacactgcaacatatctagtagggaacgaatgatcctacacaaaatacagaaaagatatccacaattgtggacaatatatatgaataacttgtttctaaagtggggatgacctgtgaatatcaatattgtgaccatcggaaaactaaaagaaaaatacctcaagcaaggcattgaagaatacaaaaaacgactctcagcctacgcaaaaatcgacatcatcgaactcccggacgaaaaagcgccggaaaacctgagcgaccaagacatgaaaatcgtcaaagacaaagaaggcgaacgcatcctggccaaaatcagcccggacacccacgtcatcgccctcgccatcgaaggaaaaatgaaaacatccgaagaactggccgatacaatagataagctggcgacttatggaaaaagcaaaatcaccttcgtcatcggcggctcactaggactaagcgacgccgtcatgaaacgggcagatgacaaactgtcattttcaaaaatgacatttcctcatcagctcatgcggctcatactagttgagcagatttatcgggcgtttcggattaatcgtggtgagccttatcataagtgagtggggttttgattaattatataaagtgattatgaaagaaagagtcactcaactattgaacgactctttctaaacgaaataaaaactgatttttttaccattcatttattaatcgtactaacttgtataattcttttttattagatgtcctctacaccaaaatacttatacaagcctttttcaatgcaatcttccaatgttccaccacaaagttctgcaactgacattatatcaatgtctttaaagcgaaatttatttgaataactattaatagatatgcttatttttaatctatttgcatcacttaaaatctctttttttactgcattattgctatgtacaatattatttctgacattcaaccaaaaccttattaattcatacttttttgtcccaacaataaagtggttttcttgcttttcaatgtatttttcgaaatatttaaggtatttaactataccattatcacttctattcataacatctttcatttcaggaagtgatggttcagattcaatgagtttcttggtcaggctaaataaagtcgattccaataaacttagaaacattacaatagatgctaaagaattcatttcaccctctaattctatttgttttaatttgaactccctttcggacacatgacgagattgaataacatctacccattccaattcatccgggtctttcgtctgttctcttaatctttgatacttttccaacatttctcgagattcttttaatttcgaatcaatttccaatttaagtctactaccatttttttttgaagaccttaatattgataaagattctaagtagtatgtatctacaatactatataaatctcttatcaaaagggacggtaaattatcttgtacttggcttatatgagaaagatgcgacattgaaaaataaaatttctgtattggaatttcctcgatattttctatctccataagcattaagcacctccgcaattccttatatattttattatctaattttcccattcgaatctatactaatgtgcattactaatagaataataggtaaattctaggtataatatactctcatgtaaatacagttcttaaaagaaatactcatttcatcattagagattctaaaaaaatcactaatattttcttattaacatgcttttttaaaaaaagaaaatgaaactgggcatcacctaaatgtgtaaaaagttataatataaattgattaaattttaaaagaatttatattactgctaatctttccttcaagatatattgatacaatacctgatatattcgatattagtaatgtacaccatctttagccaatgagtacttagaagaagaaaacactaaaaaacggaaaattagaagattgctttttaaaagaaatctttcttgttgcacatggaaggtatgaaaataaatggagtaatccccacttagaaactttacaagtaatattaaaacgaaaatttatttatttgttaatggattttgtgttgtaatctgatgattgagagaataaaaatgggaaatgtttgctaaacaaatagacctatgctataatttagaaaaggtcgaaaattgtagaagtatgaggctgtgttattaattgaattttcttttatttaaaaatgttgccgcatttttaaataaaaatatcttttagtcttactaataatttttataactaattgacttttaaaagaataacatagtgtggtaaaaaaatcaacacctattaagtttgtttaaaatatagtaaaaaattacaggaatgttaatttggagtaagacaaacttagacctctatcttttatttcttcggcttaataaccaacaagaaagcaggagatatattggcaatattaacagcaaggtttattaaagatggaatagaaaaggaatatgaaaagagtgatatcacgcccgacttatataatgaaaccttaaaaggttatctctattgtcctactaagaattgcggtgcaagggttatttataattctggtgtaaaaagctttttaagaacatggaatatggataaccatattgacgattgtattcatggttttacgagagctaaaaaaagggtaggtgttgatactactcaatttattaatgttgaactcactgctgagaggaaaaaaagggctttaaaagaagcttataagctatatactatgtctgatgatgaaaagacaatagagaaaacaaagaaaccaaccagaaaaaataatccgactactgttggaaaggaatctgttcccgtgactcacgctgttttacaagatggagatcagcctgaagaggtaactaatcgaaggataggtattagaggaccaaacctccccaaaaggacagtggatatgttaaaggatattgataatggaaaacctcgtttagtaatgggaaaagtaaagagtgtgaaattaatagaatcgatagctgatatcattgtggaagagggtaaaacaaatatccatgttaagtttgaagaagtattcataaataatagtccagcttatttagggttatttcatcacattttaaagtatcaaaaagaaaacaaaaatcaggatattgtattcactgggattggagaagtgaggagatccaaagttaatggagatttagaactttccgttttttatggaactgatttttctatagacggaatggatttaataaagctatcaatgaggaaatcttaaagtagaatttactaagaaagtcgttcaactattcaatgggcgacttttttaattatctttccatgataatgtgaggaaaacatttaaactaaaatttaataatatatggattaactgatttttattcatactcttctaaatgtaaattgcattttatcgagtgatcaataaatgagttactccttctttagacttaaaatttgaggttgctccggcatctgagttttttaatgaagagggaggacgcatttggtgttttaaggagttaaaggtattatcccttgtcggctgtaagtcatcgtacctgtttcacgattagcccgtgtaaaaatgaaaagggcacgaacatgttgatttctataaaaataaaattgaattcaattttattagtcataccttaaacgtctttttatttactcaatcgacattttatgagcagatgaaataagtatttcttgaagtctcccaagcatgatttcgtttagttcaatttgtaggtaagcttctattatcaattctaaatgcaaagatgtaaatgtataacagacccatctctagaaaggcgattctacctaaaaaaacagcgtttgtattggttttcattcttctcttacatattaataacgtcatggttatcttccacggaatttagtctgtttgctgatcattcatttttcaaaatttgttttcatttaaaataatgtttgcggtttgcagtgctaaatgaaataaaaaaagagctcaaggaatcatccctaaacctcataccctcacttcatataccgatactcccgtagcctcttcaaaatagccacttccctcaacaattcctctcccacattcgtttccttcactttctaccgctcaagctctttgtccactaatcgtttcaccgttaagacgtcggtgccggtgatcagaacttctgcctttgagtcaaagtgtttatcagcacctagctgcatgccgtaggagttgtataagagcgtttagccgacaatgcctgttgtggattggcaggctttggagaagccgccgtcgatgacgatcatttttccgtttcctaatgtctaccccgcccaaaaagaagccatcattcaagaatcccccttcaaacaacagcttcttccgcatttcccatatgtcagtataaatccctttgcgtcacggaaacctagtggaaaaggtctctgaaaggagggggcgtatgatgaaaagtgaaaaaattcaaaacaaaacatctttggtttggaagatggcgattgcatctgctgtttcgtgggaagcggcaaaactagttggctctgatcacccctatttagcgcctctttctgttatcttatgtttgcagccaacgatagatcagtcaattcgcttttcttttcatcgtattgcgggaactgcgattgggatcatgctaacgtcctatcttgtcagtcacttgccaatgaatggctggatgctggggctgttcctattaggcggtacttacattgcgaagtggttacgaatagatgtaacggttctacatcaggtagcgctcaccattttgttggtctttacgtttgaacgaaacgctaaagattatgcattcgaccgaatcatcgatacggtgatcggcgtcatcattgccatactggttcacatgttcctttttccgccggactacacaaaaaaggcagcggactcttttcaaacattggctcgtcagctttccggcacactttcagacctttccaaatgggtgcaatcagagtgggggcaaggaaaagggaaccttatggcgtatagaatgaacaatcttctgcaagagctgcatatgacaaaagagatgctgcaaacagcctctgacagcttaaaattcaaccccgtcagaaaaaaacataaaaatatcatttcaagctatcaaattgagatgcaaaagttgaacgccggatttgagtatctatcaaatatagtgaaaacgttaaaagaatgggaaaaagaaggagctttatcttcaagtgacaaaagggagctggggaatgatttacaagtgttaagtgaatactttgcgggctttaaaggcatacaacagggtgaaacagacaattggaaacagaaggaacaggacatgttattggaatctctccgttccgacatgctgtcgcacgcgccgcccggtcataaggtctataaagactcttttttttttagaaacgaaaaaattgctgaaacgtttgtaatgttttctggaaaaaaagaatacggatatacagatgcagatatgatcaggtaaaagcgggggacatgaaatggatgatatacaccggattttggatgtcatcgccaattctaaaaaagctaaggtactggctaccatcattaaagcagaggggtccgcttataagaaagaaggggcttcgatgttgattttaggggataaaacaagagttggaatgttatccgccggttgtctggaagaagatctcgttgaacggtcggaacaggtctgggttgcaggagagccgttgattgtccgctttgatatgagtgcggaggacgatttatcctggggacagggcattggctgtaatggtgttttgacggttttacttgagcctgtaaaaggagaattggaaagacatctgatgacagtcaagacatgcttagatgaaaaaaagtctgtgacccaaatgaaacgattcactaaaacgttagagctgaaggaagatctgtacatagtggaagacggcagcgtgtttggaaccggggatgttatggaacaaggccgtattcaaaaactgagacagacggaaaaggtaatcaagagggatgaacatacctctgatttattttttatccatcagatggtgccaaaaccttgtttatatgtcttcggagcaggggaagatgcgaagccgttagtttcgttggcagctcatgcgggctttcatgtgacggtgattgactggcgtcccgctttatgtcatcacggccattttcctgaagccggccatttgataacaggggcaccggaagaagtcatggaaggcctgagcatgacaaaaagggattttgttgtcattatgacgcacagctttcaaaaagatcagatcattttacatacaataaaaaacgagaatgtgttttataaaggcgttttaggccccagaaggcgcacggagcggctgttaggcggggcagagattccggcagatattcattcccctatcggccttcccatcggggcacaaggccctgaagagattgctgtaagtattgtcggcgagatgattaaagaaatgcgaacacaaaggtctcgcttatgaaaacagcagccatttacctggcagccggtacaagcagacgcatggggacggataagcgaagtttatttctgaatggagtctccctcggaagtatggctcttaaaaatgccttgttatctgaattagatcatattttcgttataacgggaaagggagatccactgcattggctttcggattttttctttttagatcccatatcaaataagtggagtcaggcagaatgtgagcaagcggataagggccaaggccattccatacaatgcggtttacaaaaagcggcagagtacgaggctgacgccgttatcattctccttgcagatcagccgtttgtcaccgcagatatcatcaatacgttaattgattcctatcagaaggagcaccgttatttatttatcgccgctgaaaatcaatatcttcctatgccccccattttattctcagatcaatgttttccagtattgcttcagttaaagggagatcagggcgcccggcatgtcatccgtgaaagtatgatcaatatgggaaaaatgatcagctttcaagaccctttgcttttttatgacgtcgatacagttgaagattatacgctgctgctgaataaattcggggagtgaatgagttggagtatatcgggaagagtgtcattcgaaaagaggcccttgaaaaagtgacgggtaaagcgaaatatacggatgattttcaagaaacaggcatattacacgcaaaaatgctggtcagtccatatgcgcatgccgatattgtgtctatggacttttcagaagcttggaagattcccggcgtgagagcgatattgggtgatgaaccttttccgcttgcaggtgaagaaattaaagacagatcgccgattgcctataaaagggtcagataccatggtgagccggttgctgttgttgtagcggaaaatccaattacagctaaaaaggcagcggatgccatcaaagtatcctataaacctcttcccgtcgtcaattccccccgtgaggcctttcaaaaggatgcgccgctcgtccatgaaaatgcggaccgctatgagaagacaaaaggtgtattcccggttccgaagacaaatatcgcaaacctggataaggttagaaaaggaaatattgaagatgggtttagggaaagtgatgtgacagcagaattccaaatttcctttaacccttctgatcacgctgcgatggaaacaagatgctcgattgttgaaattcgggcggatgaggagattatcattaccacatcctctcaagctccttttgccattaaaaaattaatggagtggtattttggaattgaacccggaaaggtgatcgtcaaaacgcctttagtaggaggagcgtacgggggaaaagcagccgttcagttagaggtgattgcctatttggcatcaaaagcagtcggaggccggcccgtcaaattgtttaatacgagagaagaggatctgatcacatctcccgttcatatcgggttggatgccattgtcaaattaggggctacaaaggatggaatcttaaaggcggcggacattcagcttttatttgatggcggagcgtattctgataaaggagtggacatcagccgggctgcggtggttgattgtacgggtccgtacgcgatcgatcatatacggtgtgattcatattgtatgtatacgaatcatccatatccaagtgcattcaggggctacagccatgctgaagtgttatttgcctttgagcggacgatggatgtattggcggaaaagctgaacatggacccattagaactccgctataaaaatgccattcgccccggtgacaccacaccgactcaagttcttctcaattcaagcacggtcggaaatgtgccgaagtgcattgaaagattgaaggaattaatgaattgggacgagggacagcgaattgaaatcgatggccggaagatacgggcgaagggaatcagctgcatttggaaaacctcaacatttgatacaaatgcaacgtccggggtgattctaacctttaatcccgatggaagcattaatttgatgtcaggggtagtggaaattggaacagggacaaaaacagtgctagcccaaatcttagcggaacgaatgaaaatggatataagcaaaattcacgtaaaaatgcttatagatacacaaacaacacccgagcattggaaaaccgtggggagcagagggacgttaatggccggaagagccgtactgaatgcagcggaggaagccattcgaaagctgaaagacgtggcatcatgtgtattgcgggttcctgtcgaggaattggaagtggccgacggaaaggtttattttatagatcatccttctgtacatgttgaaataaaagacattgcttacggatatacctttccaaatggaaataccattggcggccaaatcattgcgagcggcaattacacattaacccggatgacgaatttagaccgggaaacgggaagagggaagccgggacccgagtgggctgtcggtgctcagggaattgaagttgagttggataaacgggattatacgtatcgaattacaaaagcctattctgttgtggatataggaactgtactgaatgaaaaagctgctaggggtcaagtgatgggggggatgagtatgggaatcgcatttggaggaagagaaacctttgtatttgattcatatggcagagtattaaatcctcagcttagaacataccgcccccttcactatggagagcagcctgaatatatcattgaatttgttgaaaccccgcatgtgattgcgccttatggggcgcgcggcggcggggaacacggactgttggggatgccggcagcattgggaaattgcctttccgccgctttaggtgtccaattgaatcaacttcctctcattcccgaacgattatggaggacgcaagaggggtggaaagatgataccgtttgattttgattattttaaaccgaagaccattcaagaaacaatcaatctatttcactcgcttgcggccgaaaagaaaacaccaatgtattattccggcggcacggaaattatcacgttaggaaggctgaatatcatctatacggatgcggtgatagatctgaacgcgcttccggaatttcaaaccatccgcttttatgaaaatgatttggtgatcggagcgggcgtgtcattaacgaaactggaggaagaaaatccatttccgctattaagtaaaacagtaagtgaaatagccgatcggacgactcgaaataagatcagcctgggcggaaacatttgcgggggcatctattaccgtgaggccgtgctgccgttgctgatttctgatagtttgatagggattgcagggagagcggggattcattaccgtcccataaataaagtatttaacaaggaaatacagttgcaaaaaggtgattttttatttcatgtcgttgtcgatcgagcgtacgttgacctgccatttgtcagtatcaaaagaagacagcagtggaatgtcggatatccattggtgacagtctgtgcgctgaaaaaagatgatgagatcagaatggccttcagcggcgtatgtccatttccgtttcgttctgctgaaatggaggctgtgcttaacgataaaaaccgatcagcagaagaaagagtgcgcaggtctttacagtatgtacccaaacccgttcttgatgatgcagaaggctcaagtgaataccgaatgtttgtcttgcaaaatacaattttagatgccttacgggaattagaaggaggtccaaatgtctgatcctattacgttgaaagtaaatggcgaggaaagacagattacggtcaggccggctgatactttgttatttgctcttcgtcttcgtctcggattaactggtgcaaaaccgggctgcttaaatggggattgcggcgcctgtacggtattaacggacggggtgccgatgaaatcttgcttaatgcttgcggcagaaggggaaggaaaggacattacgacaattgaaggactgatcaatacaccgattcaaaaggcttttattgaaaagttcgcgtttcaatgcggttattgcacaccgggttttctcatgaattgtcatgctttggtgaatactgagccgaatgcaagtgatgacacgataaaaaattggctggagtccaatatttgcagatgtacgggttatagggagattgaagaagcggttaaatccgttttacatacagggaaaccgtaaaaaaagagcccagagaatcatctctgaactccattcttcatttcatataccgatactctcgcagtttctccaaaatcgccacttctttcatcagttcttcaccgacgtttgtttctttcactttcttccgctccagctctttgtcgactaatcgtttcactgttaagacgtcggttccggtgctcagcacttcggccttggagttaaagtgtttatgggcgacgagctgcatgccgtaagagttgtataagagcgtgtagccggcgatgcctgttgtggattggtaggctttggagaagccgccgtcgatgacgatcatttttccgtttgccttgatcggatcttcgccttcgatttcttttaccggtgtatggccgttgatgatatggccgtgatctggattaaggccgaattccttcaggatgtttcggcaggctgcttcgtcttcgcgcaaatagtaatacgggtttttcttttctttatgcgtttccttctctttaatgaaataccgctcaaaggttgtcatggcgcgttttccgaagagggaagagtattcgcctgtccataagtaccaagtcatatctgtcgccagatcttcggtttcttccggatgggcaaacgcttcccgtaagaaccgttcaaatacatcgagcagctctcggcccgcataagctttatcctctatcatcatcgtttccatgctgccgttttcatcgacgggaatacagccgtgaatcagcaggttgccgttatattttaaataaaggctgccttttttcatcataaaattcatatggcggcccagcttttcggagttctgaacagagaacagcagcttgtccatgacttctgcttcttcttctaacagctcgtcaggctgtttaggattcaccgtcgcaaagcaggtgttttccagttgatatgtttttccgttcagcgtgatttcattgcggtcataatcgatcttttccagtaacagccgttcctccatattaaagttcggccgtctcttaataatcgggctctcaagcttgaattggatcatcgcgatcgcctgatgaatttttgtgatttgtttaatctcatcttccggtctgttttcgtccgctttcgggcggaaagacgggttatcatcgtaatatttttcggcaaggttcaatagcggtctcagattgatgccgtaaacgtcttcaataatatccagattgtcatagcgggcacagatgcggataatgtttgccaggcatacttttgagccggaataagcgcctatccagagaacatcatgattcccccattgaatatccactgaatgatagttgatcagttcttccatgatcttatccggctgcggtccgcggtcataaatatcgccgacaacatgcagatggtcgaccaccaaacgctgcgtgctgtaggcaaggccggtgatcagcttatcggcctggccgagcgcaatgatctgttctatgatttcggaatagtattgttctttgttggcggcttgttctgttttgtacagcagctcttcagaaatataagcaaattgggcgggcagcgctttgcgcaatttggagcgggtgtacttggaagaacaataagaaacgagcttaatcatccggtgaatcgtttctttataccactcgtttaatgcctctttcgtatcaaagtcatgtttgatcagcttcagtttgtcctcaggataatagaccaaagccgccagttcatcaatttctctatcgtaaatgacgccgctgaaaatatcgcggatcttctcttttacccttcctgaaccgttccgcagcacgtgctggaatgcctgatactccccgtgcagatcactgacgaaatgctcggttcctttcggcaggttcagtatcgctttcagattaatgatttccgtgaccactttttcttcacaatcgtatttttgtgcgagcagatctaaatatttcgtttccaatctcgtccatcccctttttatttacgagcaattgtatgataaagtgaatttaaagtatgacataatgtttaaatgattagaccttatatgatagtaccgcataacgcctttttgatacaatgaaaacggaaaatacgcgcttcaggcatcaaaaattggaccgggataacgccgtgcagctcatccctctattgacaatgcattcaacttccattaaaataaaaagttagctgataggtgtttctatcagaaactcaatacgtagcaggctatgattgctgtgggtcgaactacagcaggagcggcttctggagagaccgcgggttttccgcggcgccgaagggttcacaatctcaggcaaaaggacagaagagtaccgaatatgtatttgtcatgctgttgattgtcagcggcgcagatataatttgatattcttatgaccatgagattggagggcatccaatctctttttttattggctttttttgctcgtcgttcactagagaggtaaggaggagtcagatgtggagcagcgagagctaaagagggacttatcgaatcggcacgtgcagctgatcgccattggcggcacgatcggcaccggattgtttttagggtctggtaaggcgattcagctggcgggtccttctatcatctttgcgtattttattgtaggtattgcgctttttttcgtcatgcgggcgctgggagaactgctgttatctaaagcgggctaccaatcattaacggatattgccgaggcgtatttagggccgcgtgcagcgtttgtcaccggctggacctactggttttgctggattatgacggctatggcggatgtgatcgccgtcggtgtgtatgtgaaatattggtttgatattccgcagtggattccggcacttatctgtttgctcattttattagggcttaatctgttaacggttaagatttttggagaattggagttttggttcgccttaattaaggtagtcacgattctcgcgttaattgtcatcggtgtggttctgctggtgattgggttcaaaacgcataccggaacggtttcagcggcgaatctgtgggagcacggcggcttgtttccgaacggattttcaggctttttgctttcgttccagatggtgatcttcgcctatgtcggtgtggaattagtgggtgtgtcggcggcggaaacgtcaaatccgaaaaaaaatattccatccgctatcaataaaattccattgcggattttatttttctacgtcggggcattgctcattcttttatgtattaatccgtggatgcagctgaatgcggcggaaagtccttttgtaaagaccttcagtctggtcggcatcccgttagccgcaggaatcattaattttgtcgtattaacgtctgccgcttctgcttgtaacagcgggatgttttcaacaagccggattttgtataacttaagcaaaacgaaacaagcgcctgcaagttttgcgaagctgaataaaaatcatgtgccgagccgcgcattatggatatcggttattgtgctgtcagctggcgctcttttaagcaaattgataccggaagcggcttttggcatcgtgaccaccatcagcgcgatttgtttcatttgggtgtggggcgtgattctggtctgtcatatcagatacaggaaaacccgtccggacttacatgcaagctcgtctttcaaggcgccgtttgcgccgtttatcaattacgccgtgctggcgctgtttgccgtcattctggtgattatgctgtttgcggatgcaacgcgcccggctttgctgctgacgccgctgtggtttattggattatttcttatctatcgggcgagagggagaaagacagattgaattgcttcagacggtgtactgccatgcagtatgccgttttttgttttgattggaaagcgagaatatttgttagaaatcaggctataatgattgtataatttaaaaaagtgtataattttaaattaagcgaggtgatgatatgaagtatgagaagttatctaagcttttttataaaatggatgctgattcatatgagaaagaatttaaaaagagaacaagcagctatggcagttattcaacatcattaaacatacgggggttccgaaaaggccgacccacggacgattcatttgagctattttatgtgaatacacataaactcatgaagctgaataatgaagtgttgttaaacagttccaaaatttcatcccttatcagtcagctccccgaatttgccgtcaaaccttattttgataaattaattattaatgaagcacagagtaataatgaaattgaaggaatccgcagtacaaaaaaagaattgaaagaggctcttaaagcgttagaacaatccgagccctcacataagcggtttgtcggattgatgaaaacatatcaatttatagaccgaattccgtcgtttacaagcattcatgactttagggaattatatgacgagctggtcgcagatgatatcggaacagaagatgcgccggatggtgagctattcagaaaaggctatgttgaagtgaacgatgggaacatgaccacccatatcggcgttaattctgaacagaagataacagaagcgcttgaggctttaattgcttatcttcatgatgaaacacatccccagctgtatcgttacatgacagctcattactactatgaatacattcatcctttttatgacggcaatggaagaacagcacgccttatcgttgggagttatttgtcccgatacttagaaaaatattcagccatcactttttcttacgcagttaataagaacaaagataagtattataaggcattagaggaaattcccgcacctttaaaccggggagagctgactttttatttaatggatatgctggagttgcttctgtcaggacaaaaagggattattgaggatcttgaatttaatttaatgaaactgaaacgaattaggaactatattgatagcgatcaatgggctgattataaagatgaacgtgatatttttaatatcattatcacgattaatgtatttgtaaatgatcaggttacgctgtcggtgcaagatttaatggagctctcaaataaatcgagacataaaattaacagagtaatggattatttagaacagcaaggatttgttgagctggtaagcagaaggccaaaatcttataaaatcagcgaggattgtttagaggaaatactgccttcttaattagtatatgtaaaaaagccgccattcatatggcggctttcacattaattccggatcaaataatcaaatgcgcctaaagcggcagttgcacctgatcccatggagataatgatttggttgtacgggccgtctgtgcagtcccctgcggcaaataggccgggaacgcttgtcgcgccgctcttatcgacgatgatttcgccgatgcggttgcgttcgaccgtttcgtctaaccattctgtattaggcacgaggccgatttggacgaatacaccttggagttcaacgtgtttttcttcgcctgtttcacggtcaacgaacgtaatgccgtttacgttttggtcgcctgtgatttctttcgtttgtgcatttttgtgcacagtgacgtttggcaggctgtaaagacgtttttgcaggacttcgtctgctttcagttcaggcgcgaattccagcacagtcacgtgattgacgatacctgcaaggtcaatcgccgcttcgattccggagtttccgccgccgataacggctacgtctttgccttcaaacaatggtccgtcacagtgcgggcagtatgcaacacctttgtttttgaactcttgctcaccaggtacgttgacattgcgccagcgggcacctgttgaaaggatcactgttttacttttcagtacagcgccgttttcgagttcaagttcgaagaggtcttttttctcaaggcgtttcgcgcgctgaaggttcatgacgtcaatatcataatctttcacgtgctcttcaaggcttgcagcgagcttcggtccttcagtcgctttaacgctgatgaagttttcgatgctcatggtgtcgagtacctggccgccgaagcgttcagcgacgacaccggtgcggatgcctttacgcgccgtgtagatggccgcgcttgcgccggcaggtccgccgccgacaacaagaacgtcaaacggctctttgtcggcaaactcagacgcatctgcgccgctgcccatttttgcgagaatctcttcgatggtcatacggccgcttccgaaagattcaccgtttaggaaaacagtcggaacagccatgatgtttttgctttctacttcttctttgaatgccgcgccgtcaatcattgtatgagtgatattcgggttgagcacgctcatcatgtttaatgcttggacgacatcagggcagttgtggcacgtcaggctgatataagactcaaagcggtattctccgctgatgttcttaatctggtcaatgaccttttgatcagccttaggcgctctgccgctgacttgaagcaatgccagcactaatgatgtaaattcgtggccgagaggaacaccggcgaatgtaacgcctgtgtcttctccggtacgattaacgctgaagctcggtgttctgtttaattcagttttttcaactgaaattttagatgacatggaagccagctcgtcaacgagagccagcatgtccttagaagtgtcatcgtcaccggcgcttactttgagaacaatgtcgttctcaattagctgcatgtattgatttaattgtgctttgatatttgcatcaagtaccaatggaatgcactccttagattttacctaccaaatcaaggctaggtgtaagtgtttcgccgccttcttcccatttagccgggcagacttcacctgggttttgacgaacatattgagctgcttttactttgtttacaaggttgcttgcgtcacggccgataccgcctgcattgatttcaactgtttggatcacgccatcaggatcgatgatgaatgttccgcggtcagcaagaccagtttcttcgtcaagaacgtcgaagttgcgggagatcgtttgagatgggtcaccgatcattgcgtaagtgattttgccgattttttcagagctgtcatgccagcctttgtgtacgaagtgagtatctgtagaaacagagtatacttcaacacctaattctttcagtgcagcgtattgtccttgaagatcttcaagttcagtcgggcaaacgaaagagaaatccgctggatagaagcagaaaacgctccattgacctttcaaatcttcgtttgttacatcgatgaattcaccgtttttgaaagcttttgcttcgaatggcagtacttcttttccgattaaagacataatatcttcctcctgaaatgtgatttgaaatatattaaaaagacaaagcattcactttatctttcaataataattctaattatatatagattattaaataacatttattttttgtcaagctatatggggtattattttctgcttttttttgctttagacgtctaaaaacgcctggtataagcggtttggcgctgtttgtcatgtttagcgccgggcgaaagggggattctcaattggtgaatcgaaacagtaggaatcaacccttctatatggcagtataaaccaaagggggtatgatcatgcaaataaataacattactttgtacagttgtgcgttggaggagacgaaacacttctatgaatgggtgttaggtttttctttaattgatgagtccggtgattcgtttaccatcaaggcgggagaaagtgagttgaaatttaggcgcgccgattctcactctcatccgacgtatcatttcgcgtttaacattccgaataatcgttttgatgaggcgaaggagtggataaaggataaagtcgtttttcaaacggaagatggggaggatgaggtgtatttctctcatattcaggcgcgttccttttatttcaaagatccgtccaacaatctggcggaattcatcgcgagagaaacatcgccgccaagcgcggaacatttttcgattgagtccgttctgaatatcggcgaggtgaatctgacggctgccgaagtcgtatcaaccgggagggagctgcagcgtttcggcattccggtgagaaagcatgcgcctcttagggaaaacgggtttcattttatgggtgattacaatgatggggcgtttttgcttttagggccgagcggccgccgctggattttttctgatcagcatgcggagttccatccgctgtctgttattgtgaacgggacgatccgcattgaggctgacggaaagggcggcattgacatcaggcgggcacagccgtcataaaaaagcccgggctcaaaaggcccggacttggggacattatttatagacaacacgggtgctgcacatgatgtcgtgcagcgtttttttctctccgaaggcgcccatgatgaatccgatataaagaatgagcttagatatgatatatgcgaaagcgcgtccgaaggcctggccgatggaaatccgtccgccatcttcattgacgaccttaaggccgagcaatgcttttcccagggtcccctgcatctttgaggccgtgagcaggctgaaatataagatactgatcacaaaagagctcacaagaatcgggatgacgccgaacaccagaaaagagatgttaaactgattttcggtcatgaaggggtcagccgccgcaacgcctgccgcaaataaaaaagagaccataaattgaatgataaaaatcggaattcctatgatgatttgatcaatgacgtaagccagaaaccgaatccaaaatcctgccggtctttccatgtatctttttctctcccttgctttaatctggaatattatacgtaatcattccaaattttgcaacggagcttaagcttccgcgagcagcctctttccccatgccaagcgtcccatgatcagcccgaaagccagaagggcaaacatgatgccgcaccacatcagctgatggattcccaagtgtgaaataaaccagccgcccgccgccgttccgatggtgatgccgaggttggaaaaagagacaaacaggctgttgccgaattcgggcgcctcctttgcttccgcagtaagccatgtctggctgacaatgagaccgccggaatgaacggcgccccatacgaagacgagaacggccatcggcgcgaaagacgtcccaaacccgtatatgagcaagtaggcggctgtataaagaagcggaaacaggatgacggtctttttcatatttttatataacaaagcgccgaagacgaaattcccggctatcataatcaccccgaagctcatcagcatgaagctgacccatgtgccgttcatatgggacacccgtccgaggtactccgcaaaatagctgtagacagaaaacatggccgcaaagagacaggtgacggcagcgatattgagccacaaagccagtttgcgaaggatgccgagctgacttctgaaagacattttttctgtgaccggcatggatggcaaaaagagaagaatgcccgtgaatgcgatgagactgatgatagcgccgaataagaaggcggcttcaagggagagacgctccgccagataagacgtgaaaggcacgccgaacgcaaagccggcggtgatgcctgaaaagactttcgttacggcttttccggattggccggcggggacaagccgggccgcggccgcaagcgctacagaaaagaacaccgggtggcataaagccggaatgatccgaaacgccagcatgacactgaaatgcgccgtatacgcgtagaccgcatttgaaacggcaaacatcagcaccgccaaaagcagaatgactttccggtttatgcctgaagcaagcaaggtcaaaaacggccccgacacagcgacgatgaatgcgaaaatactgacaagccaccccgcttttgaagcggtaatttgaaatctgtccgccacttgcggaagaaccccgatgatgcccatctcggtcgtaataatcccgaaaacccctagggccaaaaatagaatgaagatggaactgctttttttcattgttatgtatacctccttttataactacatatacagaaaaatagatatgttagaacaaaaaaagccctcctttcatggttatagctggtgctgaacatagtcagcaaaggctttaatttgtttttcattccttctgtaataggtccacttcccgattcgttcagattccagcaggccggctttttgcatggtcagcaggtagctggagatgacggactgcgcaagccccgactttgcctgaatatcaccgacgcaaattccggtgcggaaactgagtccctgatcaagataaggtctttcatcaaaatggtcttccgggtgtttaagccacgtcataatatcacttcgtgttttgttagatagcgctttatgaatcaatatcggttccataacgtttattatatctatttttctggatttgtaaattcgtttttaacaaaacattctcaaagtaactaaatatcgtgctaaaatataacatattatcagattaccggtaaaaaagccgggttattgtcaggaggatattcacatgaatcaaaagaaaaaaggtgcggttgcgatgaccttgctttccgctctgctgttttgtttattgccggtcatcggctcgctttctccgtttgcagaaacggggccgaacgcgaatcgttttaattccgcgggcatgtgggccgccgtcggtcagatcctttttatatatgcggtcccgctcattatgtatattctcggtgttcgtgtcatgaaaatcatcatggccgttttttgcggaatcgggcttctcatttgcgcggctgtctttttggtaacgttattggtcgtaacttcttcggaacaggagctgtctctttattacggccttctcgtttggtcaggcgcggcttttatcgtcaatgtggtgtggtatattgccgcgtttcgatcatccccgaagcatcagcaggctatgtgacatttgttctataaatctgccgaaaatacaaatatttcataggttaattatggtatgatcgaagtgatatagcagcttttaatagaaacgggaggaactaacattgaaaaaaaagacagcttcattgcgaatgaaaacattggcggccggcgctgcggttgctgcggctttatctgtgggagcggtttctgatctgccgggggcaaaatggctgcatccggcggctgctcaagctgcggaaacggtatttaaacaaaatcatgcggcatccggtttcttggcgggacggtatgacgcgcaggcgatgtctccgacgatgttcaactggtcaagagaaagccggtttacaagcactgccgatggcgcgttaaaatgggaaaagaatgttccggccaatcctcaaaacggtgcgggagccgcggttgacagggacggcaccgtatttattcaatcaaaagacgggaagctgacggcgtatcatccggacggtactgtgaaatgggtgacggaaaacctcgggacgacctatacgctgactccggtgctcggaacaaacggtgtcatttatcttccttctcacgataaaaaactatatttcatcgacaaagaaaccggaaacattttaacatcggttccgctgagcggagcgcctagttccgatgcggctatcggctctgacggcacgctgtatgtgtcgacgctggataactatatctatgcgattaaaccgacgtcgccttcgacatggacgcaaaagtggaagtttaaaacaaacggcgtggtcggttccgctcccgtgttagcatcaaacggaacgctgtatacggcaacgtacaataatatcttttacgcgatcaattccggaacgggccaagtgaaatggtcaaaaacgacgtccaacgggtttaaaggctatccggttattgatagagacggcaccgtttacgccggaaaccaggacggcaacttatacgcctatacatcaacgggtgctgtaaagtggacgttcccgttaaacggtttctccagctcttcattagcgatcgaccataacggcaatgtgtatatcggttccggaagcggcgagctgttttccatcagcaaaaccggcaatatgaactggtctttctatacggacgggcctgtgagaacggcgccgctgattgatgcggacggcaatgtgtacttcggttctgacgataaaaatgtctatgcggttgacgctgacggtaatgaaaaatggcgctatcaaacagacagcaatgtcatttcctccccggttctggctgaagacggcacgctttacgtcggcacttatacgaaactgctcgcattcggggcaaaaaaataataaaaaagaatccgcgtcatctgcgcggattctttttttatttagaggcttgtataaatacgcctttttcatgagaaaattctttaaagccgtacacaccgtgatatgaaccgatcccgctcgtattgacaccgccgaacggaaggttgacgtcagtgaaatgaacgacgacatcattgacagaagcattgccggatgtcgtatgctgcagcacataatcgatcagctcctgattatggctgaatacatacaaggcaagcggcttgtcccgttcagtgatgtaatcaacggcttcactgatatcttcgtaattcataatcggcagaatcggtgcgaagatttcttcctgcatgatcttcatatcaggcgtgacgtttgtcagcacggtcggagaaatcgtgcggtcatgcgcatcgaatacgccgccgaacgccgttttcgcccctttttcaatggcgtcatcatacagggctttgacacggttaaagttgcggtcgttgacaatctgcgtgaatttgttgcggtcaaccgtatgatcatcctccataaaacctgcattgacaatggtttgcaggagatctgtaaaggtgctctgcacttctttcttcataaggagatagtcaggtgcgatacatgtttgccccgcattgacaaatttgccgacggcgatttttttcgccgcgtccatcaaatcatagtcgctgtcgatgatcgtcgggctttttccgccaagctcaagcgtgacggacgacaagtgcttcgctgctgccgtcatgacgattttaccgacattcgtgcttccggtgaagaaaatgtggtcaaacggctggtcgagcagttctgtggcgacatcgacctcaccttcaaaaatggcgacttcttcttcgtgaaatgcctcgcgaataactgtcgcggcgatatggctcgtctccattgtaaaatcggacagcttcacaatcgcgctgttgccggccgcaatggcagctgcaagcggagccatcgtcagcataaacggataattccacgggccgagaattaaggtaaggccttttggctcgtacattaatacgccgtcagcgtcgggactgacggatgagccgacgcgtttcggcgccatccaggtgtcgagattgttcatattatctttaatcgccttaatcgttccctgcgtttccgctctttttacctcatgataaggcttgcggacgtcccgtctgatcgcctcgatgatttcttcttcatgtgcggtgacggcatctaaaaagcgctgaagcttttctctgcgctgcccggctgttgaagcacgcagcgttttttgattttttttctgaagctcaaagacgcgtttgatgtctgcttttatatgctgatccatcggtcttcctcctctggttgcttttttgtttcttcagggcctattataatgtggtgtgtttttgcggcaaagacagcgtaaacacatctatacgttaccgtacaaattgcggtgatctgtctaatgaaaggagtgtctcttatgccggattctgtgacaactgacatcaaacaagcgcttttggccatgcttggagagcgggatatccgccgtgtgaccatgaaggacatcgccgaacgggcgcgtgtgagccgggggacactgtacctttattacgaagataaatatgcgattttagaggatatagaggaagaaatgaaagacgggctgagcgaagcgctgtatgattcactgaagaataaagatgtgcttcatttacatggcggatggcaaaaagtgcatccgaccctgtcttttgttgaccggcatcgggtgtttttccaaacgatgatggatcgcaataaaatgccctattttcactttcatgcttttttaaaagatgtgttccggcatgatgtgctgctgtcaccggtcaattcggatttctcaccgactgaacaggatatgtacattcattaccgcgctttatacacgtatgccattgtgttgtactggctgaatgaggagcccggggcatccccggaagcgatcagcggacaggtgtgggatttgatttctcaaaaacggttttactggctgttcggccgccgggtgccggaacaagaagaaaaaaagcccgccgaccgccgggtgacaaggacgaggcaggccttgcaagaagccatgatcggcttaatggcggaaaaaaaagagtacgcggcaatcacgatttccgatattgcccgtcaaagcaacctccgccgtgccactttttatgaccattacgccaacaaagaagcattgctgaaaacgatcatccatcaatcatgccgggatctgatcggattattgacggtaaaaggagagcctgccgactgttccatggaagaagcggaatccgcgctcgtcggtctcttttcggcgctgtcggacggcctgccgctcgttcattttctgagagagggttcgggagtgcctgacgtcatcccggaaatgttcagagcgctgcaatcgttttatcttcatcagcccctgcacattcaggcgggcaaaaaactctatgcatattatgtcgcgtccatgctcgccggtttgattcaatatcgtcttcatgaaggaaaagaccacgcgccggatatgctggcccgggagtttctgcagtttttggatgtaaagaagtatcgggtgattttgctgtgaggatgatgaaaaagaactcagccgaaagggactgccccccgtttttgagacaggggtcaaaacaccttttaaacagccaattgccgatagtttatcggtgattggttgtttagtttggtttgaatacgaatattgttataataatgaatgtattctatgacagtgcgttctacgatggcagtcgtagttcgatcaatgctgttaagatagaacgtttcagactttagcgaggaatgaaacgattcgatggaggcattatcagcgggcgtccctttgcgggacatgctcatggtaatgccttttgttttaacagctttttgatactcgtaagatgtatacacagaaccttggtcactatgtaacacgcagttctcaggcagcattggtagctgatcaagtgtgtctaagacaaaggctgtgtcctgcttatccccaatagtaaaagcaatcacttctccattgtataaatctaatatactggaaaggtacaattgtttctgtccataaggcaaatatgtgatgtccgttactagtttttcaagaggacgatcagactgaaagttccgatccaatatattatcgaccacggcatatggctgcccatccttcttgcgctttttcaccttaacccgacactgccattgatttttctgcataatacgttgaaccgttttatggttaatacacattctcttttttagtatggctgtgatttttcgatatccatatcgatacttgtgctctcggcacaacgtgccgatttgtttttccaaatggcgcttgggatgatccttcatcagattcttcttccaacgataataagacgctcgagagatacctaaatgaatacagatatcctgtacggtcattgtgctgtgcaatatttctacaagttcgactgacgtttcgctatcaacttcctttccaattcgttgtacttttttaaaacttcattctgttgtctcaggtaacgaatctctgcctgcagtttctctaaatcggaagaatactccggaccttttccgtaagtgtattgctttccaacaggctgttcgaatcgatgtgtatcaccagccttataccatctaacccatgtctgaacctgtgtcttattcttaatattcaactcctgcaggatctctttcataggtacgcctgccaatctcatttctacagccttctgtttcacttcaaccggataactcactcttgtccccatagaaaaaacacctccaagtctaatttcggataacaatcatccgtattcaaacttgaaggtgtttttatttgtctcatcttatggggtcagtcccgaaaacaggccgggttcttttttgctgttttctctttgagaagcgccgatatgaagtgtccggctttatcccttataaaaaagataccttccatatgacgcctgatcagcattctgccgccaaacatgacaaatgtcatattcggggcatgatggctgctactacaaaagcgtctggcgccccgttatacttgggatcataatgaaaaagaagggacatgacattcatgaccaatcacaccgcaactcaaaaacaagcatctttaaaaaagcaggttgccgcattttccggcgccgatacaaagcatagtgtcaatcagcttttcaacacgtttgtgccgttttttgccctttggtttcttgcttacttcagcctcaatgtctcctatcttctgaccctcgcctttactgttatagcagcgggatttttgacaagaatctttattattttccacgactgctgccaccaatcctttttcaaacaaaagaaactgaaccggctgttcgggtttatttcaggtgtgctgaccctgtttccgttccttcaatggcagcgcagccactccattcatcatgcgacgagcagcaacttagataaacggggcaccggcgatatttggatgatgaccgtcaaggaatacaacgaagcctcagcctggacaaaagtacgctacagactttatcgcaatccgtttattatgtttattctcggcccgatttacgtatttctgattaaaaaccgtttcaatgtaaaaggcgcccgccgcaaggagcgctggaacacctatttcacgaacgcggcgattgtcttattggctgctgcgacgtgcctgcttgtcggctgggaaaactttttgcttgttcagggtccgattttccttatttcggggtcaatcggcgtctggctattttatgttcagcacacgtttgaggattcttattttgaagccgatgagcattgggattatgtgcaggccgcggtagaaggaagctccttttacaagcttccgaagcttttgcaatggctgacaggcaatatcggctaccatcatgttcaccacttaagcccgaaagtgccgaactacaagctggaagccgctcatgaggggcacgagcctttaaaaaacgtgccgaccattacgcttaaaacaagtcttgaatccatgaaattccgtctgtgggatgaggacgaaaagcaatttgtcacctttcgggaggcgcggaaaaaaccggcgccccatccggtaccgaaagaacctttgaagaaaaatgcctgatatggcgcgcggctctttctcttatcagaaagggccttctcttcatgcgtgaggatgcaatgaaggcggtgttttgataaagtgatggtagacacaagcagcagaaggtggaacaaagatgaagaagtattttaaatttcaaaaactgaacgggatttctccttatatatggacgatttttttcatcttgcctttttattttatttttaaaagctcttctacctttgtcatcgtggccggcatcattttcacacttgttttctttggcgcataccgcttcgcatttgttgcaaaaggctggccgctttacttatgggcgcttcttctgatcggcatttcgaccggctcagttatgctgttcagctatatttacttcgccttctttatcgcctacttcatcggccatatccgagacaaagttcctttttacatcttatattacattcatatcatcagtgcggcagttgccgtcaacttcagccttgttctgaaaaaagggtggtttttgacacaaattccgtttatcgtcattacactgatcagtgccatcctgctcccgctcagcattcgaagcagaaaggcacgggagcgccttgaggagaaattagaatatgcaaatgagcgaatcgccgatcttgtgaagctggaagaaaggcagcgcatcgcccgggaccttcacgatacacttggacaaaagctctccttaatcggattgaaaagcgacctcgcccgaaagctgatatataaggaccctgaacaggcccgcactgagctgaaaagcgtgcagcagacggcccgcacctcgttaaatgaggtcagacaaatcgtctcatcgatgaaaggcatccgattgaaggatgagctcggcaatgttcggcaaattcttgaagcggcaggaattgattttgtgtatgaagaaaaagaagcgcccaaacatatctctttgctgaacgaaaacatcgtcagcatgtgcattaaagaagccgtcaccaatgtcgtgaaacacagcggcgccaaagtatgccgcatcaccattcagcagctttggaaagaggttgtcattacggtagaagatgacggcagctttcaatgcaaagaagaccgctttttttcaaaggggcacggcctgcttggaatgagggaacgtcttgaattcgcaaacggcagtttagccattgatacagccgccggaacaaagctgaccatgagaatcccgaatgattcaaaatcaaaagaaaaggatggtagcagatgatcaacatcttcattgccgaggatcagcaaatgctgctcggcgcactcggttcgctgttgaatttagaagaggatatgacggttgtcggtaaaggcacaagcggccaggatgccatcgatttcgtggaaaaacatgcgcccgacatctgtctgatggatatcgaaatgcccgggaaatcaggtcttgaagcggcagaagaactcaaggacagcggtgtgaaaatcatcattttgacgacctttgcccgctccggctattttcagcgggcgctaaaagccggcgtcagcgggtacatgctcaaggacagcccgagcgatgagctcgtcagcgccatccgcagcgtcatgaaaggaagacgcgtctacgcccctgaattaatggaggacatctatagtgaagaaaacccgctgaccgaacgggaaaaagaggtgctcgagcttgtcgcagacgggaaaaacacgaaagaaatcgcaaacgccctcagcatcaaaagcggcacagtccgcaattacgtttcgatgatcctggataaattagaagtgaaaaatcgaattgaagccattacccgatcaaaagaaaagggctggtttaagtaacctgccctcagcttgttcagccagtgtttttgcactggcttgtttctttttcgccgtcactccgtctcttccttccacttcttatcaatcagcatttttcccggccaagtgtatgccatgatgccgccgtctgcggtgatgtcttctcccgtgacgtaagaactgtcgtctgaagcgaggaagagcgcgacggctgccatttcttccggttttccaagccggccgagcggcgtgatccatttgttggcttcacggaacgcctcgcccatttcgtcttctgtcgtgcctgccaatttatcaatgagcggcgtttcaatcgtccccggcgataaggaattgacgcggattccgcttctggcgtaatcaatggccatcgctctcgtcaggttcgtgattccgccttttgcggcgttatagcctgagcggtcaaggtctgcggcccggccggacatggaggaggtgttgatgatggagcctcctttttcgagcatgagcggaatcaggtatttgctgcaaagaaatgtgccgcgcagatcgacggcgatgatccggtcaaacaggtcgaccgggtattcatggacttttccgccctcttggtcaacaccagcattgttaaacagaatatcaattgttccgtactttcgctgaatgctgtccgcaaaagactttacgttttcttcgtctgatacatcaaggtgaaaggcttctgcttctccgccgttttttctgatagcgctgacggtttcattcagttcgctttcattgatgtcaccgcagatcacgcgggcgccttcatcggcgaaaacccgtgccgtcgcttgtccgatgcctgtcgcggcccctgtgatgattgcggttttgtctgttaatcttcccatattgcgattcctcctttttttatatctgttcccgctgaatagggggataaacatacggaggtctgtttctaaatacctattaaatatgttaatattatgtatatacatcattgggaggtttacatattttgaagatacagcataagaaggagatagcgttttattgttatgccattgttcctatgggatttgtgatttacaccgttatctctattctatttcaggacatcatatttcctctcactgtaagaaatgttcttcatgagtctttgcgaaacttgggatctcttatcttatttagtttgtttttctatccgtcatacatatggatgaagaaggaattcggccgccggaaagaagcagagaggagaggatgatcaacattctctcttttttattgataaaatgggtgaaatgaatccattaacatgttaaatttacaatatatgcatctgctaatcctagttgacaattgtcactgtatatgataaatagatgctgaaaagattttacataacatcaaagcataattaaaggagagatctgaagtgcggaaaaaaaagtttaaagcagaatccaagcgattgctggacatgatgattaactccatttacacgcagaaggaaatttttctccgcgagttaatttccaacgcgagcgatgcgattgacaaaatctattacaaggcgttaaccgatgattcattaacgtttgatcaagacaattactacataaaagtgacggcggacaaagaagcgagaacgctcaccgtcacagacaccggtatcgggatgacaaaagacgagcttgaacagcatctcggcacaattgcgaaaagcggttcactcgctttcaagcaagaaaatgactcgaaagacggccatgacattatcggccagttcggcgtcggattttatgcggcgtttatggtggctgataaagtcacggtgaaaagtaaggcgctcggcagtgacgaggcgtatgtatgggagtcggaaggggccgccggctacacgatcgcgccgtgtgacaaggaaaccgtcggtacggaaatcaccctacaaataaaagaaaacacggaagatgaaagctatgatgagtttttagaaaactaccgcatcaaagcgatcgtgaaaaagtactctgattttatccgctacccgatcaaaatggaagagacggtcaacaagccgaaagagggcagcgagaacgaatttgaagaagttcaggaagaacagacggtcaacagcatggtgccgatctggagaaaaaacaaaagcgagctgacagatgaggattacgaggctttttacgccgagaagcattacggctttgataaaccgctgacccatgtgcatatcagcgtcgatggagcggtgcgctacaattcgattttgtttattccggaaaacatgccgtttgactattatacgaaggaattcgaaaaaggattggagctgtattccaacggcgtgctgatcatgaacaaatgcgccgacctgcttccggaccatttcagctttgtaaaaggcatggtggattctgaggatctgtcgctgaacatttccagagagatgctgcagcacgaccgccagctgaagctgattgcgaaaaacatcaataaaaaaatcaaagccgagctgaagagcctgctgaagaacaaaagagaaaaatacgaatctttctatgaatctttcggcagacagctgaaattcggcgtctataatgatttcggcgcgaataaagacgtattaaaagatctgcttctcttctattcatctaaggagaaaaagctcgtcactctggacgaatatgtgtccagaatgcctgaggatcaaaaatatatctattacgcgtccggcgattcatatgagcggattgaaaagctgccgcaaactgaaatggtggcggacaaaggctacgaaattttatatttcacggaagatattgatgaatttgcgatcaaaatgctgacaagctatgaggaaaaagagttcaaatccgtatcaagcgccgacttaggcatcgacagtgatgaggatgaaaagcagactgaagccgaagagaacgaatataaagacctgttcgaaagcatgaaagagattcttgcggataaagtaaagaacgtcagagcgtcgaaacgtttaaaatctcatccggtctgttttgcgacagacggcgaagtgacgatcgaaatggaaaaagtgttgaatgctatgcctgacagccagcaggtcaaagcggaaaaagtgctggaaatcaacccgaatcacgaagtgtttgagacgttaaagaacgcgcacggacaagatcgggaaaagcttgcattatacacaaatcttctctacaatcaggcgcttctgattgaagggctgccgatccatgatccggtcgaatttacgaatgacatttgcaaagttatggtatgacgccaaaaaggaatcgcccagcgggggcgattcctttttttattacagtgtgcgctgtttaagaatttgattttgtttgctgcgcttctttaaggagaaccgttttttcaagtgcgtttcgatttcttctaaacttctgcccttcgtttcaggaacgatgtaagcggcgaagaagaaggatgagaggcaaatgactgagaatattccgaatacccagccgatgcccatggcgctcagcataagcgggaataccagtgaaacgatcaggttggttgccgacagaatcaatgtcgtaaatccggttgcggctccgcgtgcgtttgacgggaacagctccggcatcagaacccatacgacgggaccccatgtcgcctggtagaagacgatatagatgccgagaaacagcacggtcagccatgctgttgaagctgacaggccggccagaaggagaatggctgatagtgacgccaggctcaaggtaatgccgacgcttccccacatcagcagttttttccggccgatccggtcgattaagatcatggcggtgatacacatgatgacgtttaagacaccgatgcccatcgtgccgagaacggacgccgaagtgccgagtccggcctttgtaaagatggtcggcgcatagtaaatcactgtgttgataccgaccgcctgctggaagatggcgaggccgatcccgatcagcagcataggacggatccattttgctttcagcaagccgagcgtagattcttttttctcggcttctccttgtttcatttccgccaattcaacggcgatatcctctttgtcgtgggtcatttccatgacttgtctggcttcctgctcacggccgcgtttgacgagccatctcggagattccggcataaacgcgattccgattaataaaagcgccgccggtactgcggcgagaccgaccatccagcgccaagcttcaaacggggtgaatatgtaattcacgatatatgcgagtaaaattccggttacaatcattaagttattcaatgtgccgagcgttccgcgtatttttgtcggcgccatctcagatagataaacgggaaccagcgccgttgagcccccgacggctaacccgagaatgacacgggagataatcagcatggtgacggtttgcgaagccgcacaggcaagcgcgccgataataaaaatgagtgaaaggacgaaaaccacttttctccggccccatcggtcagagcatgtcccgcttaatgcggacccgaaaatcgcaccgagcagcagcatgctgacgaccaatccctcggtcagcgtgtttaaaggaatatcattgttaataaataacaaagcccctgaaatcacaccggtgtcatagccgtaaagcagcccgcctaatgctccgaaaaagtaaatcaggtattttttggtgtttttcttcacagatgatcctcctcatcttttggaacgcataatagtttatttagataactatttcattccccgaagagaaaaatataaacataaaaaaacacgcccctttaagaggcgtgtttttttcttaggaaaacagcttgtcgataaacgcgatttcttcagcagatagcgtaatggaggctgctttcatgttgtcttttaattgatccgcgcgtttggcgcccggaatcaggatatcgatttcaggtctcgccaagtaccaggcaagcacgatatgcgccgtatcggcattgtgcttttcggcaatcggtttgagctggttgacttttttgatgttttctttaaactgctccccttggaaatgcgcctggtcattgcgcaggtcgccttcagggaaggttgtgttctcgtcgtatttgccggccagcagtccggatacgagcgggaagtacggaatgaatgagatgccgtgttctgtcgtataagggaagaaagtcttttccgcctcacggttcagcaggttgtattctccttgaatcacatcgactaagccgtctttattggcttctttcagctgctccaaagagaaattggatacgccgatggaacggatttttccttcttttttcagctcattcaacgcttgaacggcttcgtccttcggcgtgtgctcatccgggaaatggatgtagaataaatcgatgtaatcagtctgcaggcgtttcaggctgtcttcgaccgattgtttcaaaaaggccggtgaattgtcgaaaacaaagtcatcgccttcttttctgtgagcggcttttgtggcgatgaagacatcctcgcggttgcattctttcagcacctcgccgattaattcttcagaacggcccacaccgtaaatataggcggtatctaacatggtaacgccgcttttaatcgcttcccggaccaattcttttcccgtttcttcattcagattcggatagagattgtgtccgccgaccgcatttgttcccaaaccgatcggaaatacctttaggtcagttttgccgattgttactttgctcatgttttcgccccctgaaaaaattggatatcatagcggctgccggaaaaatacggcagcgttctctattaactataacgctatgccaagtgaatgtcgatttgatgctcttggcaatacttcgtatattcctcatcgagctgctgagaagtgacaatgctgtgaagccggtcgaaaggcgcgtatgtcaaaagcgtggatttgccgaatttggaatgatccgcgagcagatacacttcgttcgccttttcggaaattctctttttcacctcgtattccagtaagtcggaattcgtcaggccgtgggtgatcgttgtcccggtagcggacatgaacgccttgttaatgttgtatttattgagtgtgctcggatcatcaatgccgacaaacgacctagtcttccgtttgtagttattgccgatgatgatcaggtcgatatttttcatggatgaagcggcgttaataatatcaaggctgttcgtcaaaaccgttacattcttatcgggatcaagcgtctccagcatcgatttggtcgtcgtgccggaatcaataaatacaagatcgtgatcctcgataaaccgtgacgcatagcgggcgattttgattttttcatcctgatgttgaatggtgcggttttcaaaagggacgagcacagatttttcggctgacgtcacgccgccgtatacctttttgataacccctttttccgcaagcttattaatatcgcgtctgaccgtgtttttagagacattgaatacctcgcacagctcatccagcgaagtggctccgtgtttgagaatgtattcttccatctcctgaatccgcatcagtttcataaaaaaactccttctagaattcttaaagtaattaaaatatataataaacaccagaagttaatcaatagttacttaacaaatgattaaaaagagagttcacgccgtacgattcgacacggttctccaagttcctgttttcccgatcaaaaaaagtatgataaaaataatgaaaaaattttgattttttagattgacttgaagatgtgttgggcttacaatgtaaccaagaaatgaccaaaacataacctgtaaaatcaaaagtgaaagatgtaaccgtttgctttttccggtacatgaccaacttttacatggaaagattgggagtcaccatcattttagcatttgtaagcgtttaattcatgtcttttatatgtaaaagatgaatatattcatccgttattatccagctgaacaggatgtttactatttaaggaggcaatgagaatggcagagatcagaaaactgaaaaactacatcaatggtgaatgggttgaaagtaagacagatcaatatgaagacgttgccaatccggctacaaaagaagtgatgtgccaggttccgatttctacgcgggaggatgtggaatacgccgtccgctcagcgtcagaggcgtttcaaacatggtcaaagacggcagtgccgcgccgtgcaagaattctatttaactatcagcagcttctccagcagaacaaagaagagcttgcccgtctgatcactttggaaaacggtaaaaacacgacggaagcactcggtgaagtgggacgcggaattgaaaacgtcgaattcgcagcgggcgcgccgtcactcatgatgggcgattcactcgcctccatcgcgacggatgtagaggcggcgaactaccgctatccgatcggggtggtcggcggtatcgcaccgttcaacttcccgatgatggtcccgtgctggatgttcccgatggcaatttcgttaggaaatacgttcattctgaagccatctgagcgcacgccgctgttaacggaaaaactggcagagctgtttgaacaggccggtctgccgaagggcgtcttcaatgtcgtgcacggcgcgcatgacgtcgtaaacggcgttcttgaacatccggatattaaagccatctcattcgtcggttcaaaacctgtcggcgagtatgttttcaaaaaaggcagcgaacatttgaaacgcgtgcaggcgttaacgggcgcgaaaaaccatacgatcgtgctgaatgacgcccaccttgaagatacggtcgcaaacattatcggcgcggcattcggttcggcaggagagcgctgcatggcatgcgcggttgtgacggttgaagaaggaatcgccgatgagtttatttcgaaattacaggaaaaagcagcggacatcaagatcggaaacggactggatgacggcgtgttcttaggcccggtcatccgcgaggacaacaaaaaacgcacgcacagctatattgaaaaaggcatcgaagaaggagcgagacttctttgtgacgggcgtgaaaacgcaacggaagacggctatttcgtcggaccgacgatttttgacaacgtgacgacggatatgacgatctggaaagatgaaatctttgcgcccgttctgtcggtcatccgcgtgaaaaacttaaaagaagcggtggacatcgccaaccagtctgaatttgcgaacggcgcgtgtctgttcacttcaaatgcgaacgcgatccgctacttccgtgagaatattgacgcgggaatgctcggcatcaaccttggcgtcccggcgccgatggcattcttcccgttctctggctggaagtcttctttcttcggcacattgcacgcaaacggaaaagacagcgtcgacttctatacacgtaaaaaagttgtgacggcacgatacccgtctcctgacttcaattgatctgacagccggcccggacggctttgtgattccgtccgggttttcttttaccatccattaaggaggaataaacatgagtcatttgctgcgcaaaccgcaggccgatgagatttctcaaggcgtgaacatcatacatgacgtcacttcagccaattcagacctcaaatacgtcggatttaaagtcgttgacctcactcccggttccacatatacagaggatttgaaaaagacggagtgctgcatcgttgcggtaacgggaaaaatcaccgtcactgattatgatcagacatttgaaagcatcggcacccgtgaaagcgtatttgaaagaaaaccgacggatagcgtttatgtgtccaatgaccgctcttttgaaatcacagcggtcagcggggcgagggtcgcgctgtgctattctccgtccgaacaccagcttccgacaaagctgattaaagcggaagacaacggtgtggaacatcgcggcaagctggcaaacaaacgaaccgttcataatattctccccgattcagatccatcggcaaacagccttctcgttgttgaagtttacacggacagcggcaactggtcgagctacccgcctcataaacatgaccaagacaatctgccggctgaatcctttttagaagaaacctattaccatgaaacggacccgccgcaggggtttgtcttccagcgtgtgtacacggacgaccgctcgattgacgagacgatgaccgcagaaaatgaaaacgttgtcatcgtaccggcgggctatcacccggttggtgttccggacgggtatacctcttactacctgaatgtaatggcgggaccgacacgaaaatggaagtttcataatgatccggcccatgaatggatcctggaacgctaacaagtgaggagtggcagataacgatgaaatatacgtttaatgaagaaaaagagtttgatattgtcgcgatcggacgcgcgtgtattgatttgaacgcggcggaatacaaccggccgatggaagaaacgatgacgttttctaaatatgtcggcggttccccggcaaatattgcgatcggcagcgccaagctcggattaaaagccggttttatcggcaaaatcccggacgatcagcacggcagattcatcgtttcttatatgcagggaaagggcgttgatacgtcacaaatgaccgttgacagagaagggcgcaaagccgggctcgcttttacggaaattctcagtccggaagagtgcagcattctgatgtaccgggatgacgtggcggatttgtatcttgagccgtccgaagtcaatgaaggctacatcgcaaacgcgaaaatgctgctcgtatcaggtacggcgcttgcgaaaagcccgtcgcgcgaagccgtcttaaaagcggtgcatatcgcaaaaaaacatgacgtaaaagtcgtgtttgagctcgactaccgtccgtatacatggcaatcggcagaagaaacagccgtgtactacacgctggtggcggaacaatccggtatcgtcatcggtacgcgtgatgaatttgacgtaatggaaaaccgcagcggcggaaataacgatgaaaccgtccgccatttgtttgcgcactccgctgaccttgtcgtcattaagcacggcattgacggatcatacgcatacagcagatcgggagaagttttccgggcgcatgcctataaaacaaaggtgctgaagaccttcggagcgggtgattcctatgcgtcagccttcatctacggacttgtcagcggccgggatattgaaacggctttaaaatacgggagcgcttccgcttccatcgtcgtcagcaaacacagctcctcagaagcaatgccggctgccggtgaaatcatcgaactgattgaagcgcagcacagtcttaacggtaaatagaacgtataaaaggtgggatcgtttgtgggtaagacaattcgcttaacgacagcacaagcgctgattcaattcttgaaccggcagtacattcatgttgacggaaaagaagagccgttcgttgagggcatcttcacgattttcggccacggaaatgtgttggggatcgggcaggcgcttgagcaggacgccgggcacctgaaagtctatcaaggcaaaaacgaacaaggcatggcgcatgccgcgatggcatacagcaagcagatgctgagaagaaaaatttacgcggtatcgacatcggtcggtccgggtgccgctaacttgacggctgccgcgggtacggcgctggccaatcatattccggtgctgctgcttccggccgatacctttgcgacgaggcagcctgacccggtgcttcagcaggtggagcaggaatacagtgccgccgtcacaacaaacgatgcgttaaagcccgtgtcccgctattgggaccgcatcacccgccccgagcagctgatgagcagcttaatccgggcgtttgaagtgatgacagatccggcaaaagcgggtccggcgacaatctgcatttctcaggatgtagagggagaagcatttgattttgatgaaagcttctttgaaaaacgcgttcattacattgaccggatgcagccgagcgagcgtgagctgaaaggcgccgcggagagaattaaggagagcagccgtcccgtcattttagtgggcggaggcgcgaagtactccggcgcgcgtgaggaattaatcgcgctttctgaaacatacggcattccgcttgtcgaaacgcaggccggcaagtcaacggttgaagccgattttgccaacaatctgggcggcatgggcatcacgggcaccctcgccgcaaacaaagccgcccgtcaggctgatctgatcatcggtgtcggcacacggtacacggactttgcgacatcctcgaaaacggcgtttgattttgacaaagcaaaatttttgaatatcaacgtcagccgcatgcaggcttacaagcttgacgcgtttcaggtcgtagccgatgcgaaagtgacgctcggcaggctgcacggcttattagacggatataaaagtgcattcggcacggcgattaaagattggaaagatgaatggctcgttgaacgggaccggctcggcaaggtcacttttacacgtgacgcgttcgaaccggaaattaaaaaccatttctcacaggatgtgttaaacgagtatgccgacgcgctcgggactgagctgccgcagacaacggcgctgttgaccatcaatgacacgattcctgaagacagcgtcgtcatcagttcggcaggatctcttccgggggatctgcagcggctgtggcattccaatgtcccgaatacgtaccacctcgagtacggctattcctgcatggggtatgaagtatcaggcacgctcggcctcaagctggcccatcccgacaaagaagtctattcactcgtcggcgacggaagctttctgatgctgcactcagagctgattaccgcgcttcaatataacaaaaaaatcaatgtcctgctttttgacaactcgggattcggctgtatcaacaacctgcagatggatcacgggagcagcagttatttctgcgagttccgcacagaggacaatcagattttaaacgttgattacgcgaaggtggcagagggctacggcgctaaaacatacagagccaatacggttgaagaactgaaagcggcgcttgaagatgcgaaaacgcaagacgtatccactttaattgaaatgaaggttctgccgaaaacgatgacggacggctatgacagctggtggcatgtcggcgtggcggaagtgtcggagcaggaaagcgttcagcgggcatacgaagcgaaagagacgaagctgaagtctgcaaagcagtactagaggggaggcatcacgatgggcaaacaagatattctgtggggcatcgctcccattgggtggcgcaatgacgatatgccggaaatcggagccgggaatacgctgcagcatttgttaagcgatattgttgtcgccggctttcaaggtacggaagtgggagggtttttccctgaaccctccgtcctcaataaagagctggctctccgaaacttgcggattgcggggaaatggttcagcagctttatcatacaagacggtattgaaaaaatggctgaacaatttacagaacactgtgattatttgcagaaagtcggagcggatgtcgccatcgtttctgaacagacgtacagcgttcagggcttggacattgatgtatttaaggaaaaaccgcacttctcagatgaagaatgggatatgctgtgccaaggcttgaaccgtctcgggaaaatcgctggcgaatacgggctggacctcacgtttcatcatcatctcggcacaggcgtccagacggcggaagaagttgaccggctgatggatggaacggacccgcggtatgtccatttactttatgataccggccatgcctatatctcggacggagactatatgacgattctcaacaagcatatggatcggatcagacacgttcatttcaaggacgcccggtttgacattatggagcggtgcagacaggaaggcaagtcattcaggcagtcgtttttacagggcatttttacggttcccggcgacggatgcatcgattttaccgaagtataccgaacgctcgtccgtcatgattattcaggctggatcgtcatcgaagccgaacaagacccggcagtcgccaatccgcttgagtacgcgctgattgcaagaaagtacatcgacagtgaactgcttgatcctgcaaattagagggggacttatatgaatagtgccaaggcggaatcagctttcagcaaaaggaccatcgccgcagcattagcaaattacattgatgcaggttccatcgtggcaggatcagcgggtttatctatgtgggtcagctacttgaagctgtccgacagccagatcggattgctcggcgccttcagcgcaaacgcgatatcagcggccatcggagcgctgctcggcgggtatttggctgataaggtcggccgaaaagctgtatacacaaacagtatgctcgtctacgccttaggaatttgtttggttttgtttggatttaactttcccatgctgttatgcggatacatgattatcgggatttctgtaggcgcggatattacggcttcatggaccattatcgcggaaaacgcccctgagaaaaaccgggcgaggcattgcggagtggcgcaggtggcgtgggccgcaggagccgttgtggttctgctgttatccgttttggtcggtgacctcgggcttctaggaaataaaattgtctttgcgcatctattggtgatcgccctgatcacatatgtgataagaaagcgtttacctgagtcggatgcctggaaaaacagtgaagagcggcctgccgccgtgaaaaaaacatcttattttgacctgcttcagccgaaatttttcaagaacattttgtttttaatgggtgtgtttctcgtatggaatctcgccgcgggcgtcatgggattcttcatgccgtacatctaccagcaggtcggcggcgtatccgcaaatacggccaacattctgcagatggccctgtttatcttcaccgggctcggcgtcgcctgtatcttcatgccttttgcagataaatatcggaaaacggtgttcggaatctgcgcatgtatggccgttgtcggctggtcgctgtttttactgccgtttcaggggctcccgatgctgcttttgtttgttttagcgatcggcatcaataacggagccggccagcaggcgaactaccagctgtgggcaagcgagctgttcccgacagaacacagagcgtcagcacaagggctcatgttctttctcgtccgtatttcaatcggaatttggagtttatttgtgccggtcatcatgtcacaattcggcatcggttttatggccggtattctgctcatatgtgtgacggccagtatgatcatcgggcttgtcttcgcgccgaatacgtccggcaagtcgcttgaacagatacaggaggaactgtacggcgctcctcaggacggcagcgggaaaagaaagacgagaaccattatttgattatcagaaggagtggcgatcaatgaatttacgtataggtgttatcggaaccggtgctatcggaaaagagcacatcaaccgcatcacaaataagctgtccggcgcggaaattaccgctgtcacagatgtgaatcaggaggccgcgcagcagaccgttcaggatttcaatttgaacgcctccgtttatcctgatgacgacagccttctcgctgctgaaaatgtggatgccgtcttagtgacaagctggggcccggctcacgagtccagcgttttgaaagcgattcagcacagcaagcacgtgttttgtgaaaagccgcttgcgacaacggcagaaggctgtatgcgcattgtcgaggaagaaatgaagacgggaaaacgattggtgcaggtaggtttcatgcgcaggtatgacagcggttacgttcagctgaaagaagcgattgacaaccgcgtggtcggcgagccgctgatgattcactgtgcgcaccgcaacccgacagtcgcatcgaattattcaacggacatggccgtcatcgatacgctcgttcatgaaattgatgtcctccactggctcgtcaatgacgactatgaatccgtacaggtgatctatccgaagaaatcaaaaaatgcgctgccgcatctgaaagatccgcagatggtcatcatcgaaacaaaaggcggcatcgtcatcaatgccgaaatctacgtgaactgtaaatacggctatgacattcaatgtgaaatcgtcggggaagacggcattatcaagcttccggaaccgtcaagcatcagcttgagaaaagaagggaaattcagcaccgatattctgatggactggcagcgccgatttgtggctgcgtatgatgtggaaattcaagacttcattgattcgatccggaataaaggcgaagtcagcggtccgacggcatgggacggttatattgccgcggtaacaactgacgcgtgcgtaaaagctcaggaatccggacagaaagagcctgtggcgctgcaagagaaaccggcattctaccaatcatttacgactgtgaacaaataatagatcgggagtgaaagaaatgaaactggccttagatccatccatgtaccgcgatgatttaacgttagaagaaatggtctataaaacggcggaactcggatacgaatatatcgaactgtctccgcgcgaggatttttgtcctttctataaatatccgaaagtcgattcagcaaaaatcaaacaattgaagcgccttttaaaagatacaggtgtgaagctgtcctctcttcttccgctttaccactgggcgggtcctgatgaagaccgtcgtcaggccgccgtgcgcaactggaaacgggcgatcgaaattgcggttgaacttgaagtggatttgatgaacagtgaattcagcggttcaaaatatgatccgttgacaagtgaagaaaaatttatcaaatccatggatgaactgctgcccgtctttgaaaaagaaggcgttaaactcaatctgcaggctcacccgtacgattttatcgaaacgcacaaaggggcgatggatatgatccgcgcgcttgacaaggattggatcaatcttgtctactcgactgcgcatacgttcttctatgatgacggaaaaggcgatattgcgaccatgtttgatgaagccggcgaccgcctcacacatgttttatttgcagatacttttaatcataaagcggcgcatggcctgcgctacatcgtcaacccgcctgacgcgaaagtaacggttcaccagcatttggacatcgggcaaggcgaggttgattttgaaacgattttcagaaagatgagagagatgaaattcgacggaattgcgacgaacgccgtttttgcttgggtcggcgaaagagcggatgaatcaagccggaccacgcttaagaaattaaaggaagaattaggtatggcataagctgagtacggagttcggcggagcggggcaaacaagccctccagccggactcccttcatatcgaaaacgcggatgggagaggctgacatgaaactttgctttaatgaagcgactacgctggagaattcaaacctgaaacaggatttagaactgtgcgaaaagcacggctatgattatattgaaatccgcacaatggataagctgccggaatacttaaaagaccattcactggccgatctggcggaatattttcgcacccatcacattaaaccgcttgccctgaacgcactggttttcttcaacaaccgtgatgagaagggctatagggagatcatttcggaattcaaaagcatgatggaaacctgcaggacgctcggcgtgaaatatgtggtggccgtgccgcttgtgacagagcggaaaatcttgaaagaagagatcaaaaagagcagcatagaggtgctgactgagctttcggacatcgcggagccgtacggcgtaaacattgcccttgaatttgtcggccacccgcaatgtacggtcaatacatttgaacaggcgtatgacatcgtgaacgctgtcggccgcgataatgtcggactggtgtttgacagcttccatttccacgcgatgggctccaatattgagagtttgaagcaggcggacggaaagaaaattttcatctatcatatcgacgatacagaagactttccgatcggctttttaacggatgaagaccgcgtctggcctgggcagggtgcgattgacttagacgcccatctgtcagcgttaaaagaaatcggattcaatgatgttgtctccgtagagctgttcagacctgaatattataagctgactgcggaggaaacgatcaaaacggcaaaggaaacaacggaagccgtcgtatcaaaatacttcatgaaggaggcgtgaacatggcttttgtcaccatgaaacatcttcttgcagaagcgaaacgggagcattatgcagtcggccaatttaatatcaacggcctccaatggacgaaggcgattctgcaagcggcgcaaaaggagcaatcgccggtcatcgccgcggcttccgatcgtctggtcgactatttaggcggatttaaaacgatttccgccatggtcggcgcgttaatggaagaaatggcgattaccgttcccgtcgtgctccatcttgatcacggaagcagtgcggaacgctgcagacaggccattgacgccggcttcagctcagtgatgattgacggctcccatcatccgattgatgagaacatcgcgatgacaaaagaagtcgccgattatgcggctaagcacggcgtctcagtagaagcagaagtcggcatggtcggcggcatggaagacgggctggtcggcggggtccgctatgccgatgtcgccgaatgtgagcggatcgtcaaagaaaccaatatcgacgcgctggccgccgccctcggctccgtccacggcaaatatcaaggtgaaccgaatctcggatttaaagaaatggaggctatctcccgcatgactgatattcctctcgttcttcacggagcatccgggattccgcaggaacagatcaaaaaagccatcacgctcggccacgcgaaaatcaatatcaacacggaatgtatggtcgcctggacagaagaaacacgccgcatgtttcagaaaaacggtgatctgtacgaaccgcgcggctacatgacacccggcattgaagccgtggaagagacagtgcgaagcaaaatgagagagttcggatcagccggtaaagccgtaaaacagcaggtcggctgatgagaacggaaaccgccaagatggcggtttttttgtgcggtgttgcgcccgtacgcccgaaacgattatgatgatggcagcagtgtaagaaacgggagtggttcagtttgaataaaatcatgattgtggaagatagtgaagacattcgcggactattgcagaattaccttgaaaaatacggatatcaaaccgtggccgccgcggatttcacggctgttcttgatgtttttttgcgggaaaagcctgatgtggtgctgcttgatatcaatctgccgtcttatgacggctattattggtgccgccagatccgccagcattctacaagcccgatcattttcatctctgccagaagcggggaaatggatcaagtgatggcgattgaaaacggcggagatgattatatcgaaaaaccgttttcctacgatattgtgctggcgaaaatcaaaagccagatccggagggcgtacggagagtacgccgccaagcagggagagaaagtggttgaatatgccggtgtgcagctctttgtagaacggtttgaactgcgctttcaggacgaaaaaagcgagctttctaaaaaagaaagcaagcttttggaagtgctgctggagcggggagaaaaggtgacgggaagagaccggctcatggaaaaaacgtgggacaccgacattttcgtcgatgataatacgcttaacgtgtatatcacgcggctcagaaaaaaactgcgggagctgaatgcgcctgtttccattgaatcggtgcggggcgaaggctaccagctgagggcgctgtcatgaagctgtttctccggtctcatgccgtgctgattctgctttttctccttcaagggctgtttgttttcttttattactggtttgcgggtcttcattctttttcccacctgttttacatattgggcgtgcagcttcttattttggcgggatatcttgcctatcgctggtacaaagaccgcggcgtgtatcattggctcagctcggagcaggaagggacggacatcccgtatctcggttcttcagtgttttgttcagagctgtatgaaaagcagatggagctgacccggatgcagcaccagaagctccatgagaccgaagccaagcttgacgcgcgggtgacgtatatgaaccaatgggtgcaccaagtaaaaacgccgctgtcggtcattaatttaatcattcaggaagaggatgagcccgtctttgaacaaatcaaaaaagaggtccggcagattgaattcgggctggagacgcttctttattcttcaaggctcgacctgtttgagcgggattttaaagttgaagcggtttccttatcagagcttctccaatcggtcattcaaagctataaacgattttttattcaataccgcgtctatccgaaaatggatattcgcgatgatcatcagatttacaccgatgcgaaatggctcaaatttgcgatcggccaagtggtcacaaacgcggtcaagtattcggcaggcaagagtgacagacttgagctgaatgtcttccgcgatgaagacaggacggtgcttgaagtcaaagattacggtgtcggcattccctcgcaagatatcaagcgggtgtttgacccttattacaccggcgaaaacggacggcgtttccaagaatctacgggaatcggccttcatctcgtcaaagaaattacgggcaagcttaatcatacggtggacatcacttcgtcctccggtgaagggacatcggtccgattttcatttcttacaaaaatgtaaggctgcgttaagaaaacaacatagctcgttttgtttccccttgataacatggatttatgtcaaggggatttttatgttaaatgccccggcactacatgaaagcagcccagaccaacaagaataaaatcataaggaggattttcatggcgaatatgcttgaagtcaaacatataaataaaacctataaaggacaagtgtcctatcaagctttaaaacaaatttcgttttcaatagaagaaggcgggttcacggcggtgatgggaccgtccggctccggaaaaacaacgcttttgaatatcatttcaacgatcgaccggccggattcaggcgatatcctgattcacggagaaaacccgcaccggctgaagcggacaaagctcgctcatttccgccgcaagcagctcggatttgtgtttcaggatttcaaccttctggacacactgacaatcggtgaaaatatcatgctgccgttaacgcttgaaaaagaagcgccgtctgtcatggaagaaaaactgcacggcatcgcggcaaagctcggaattgaagacctgctcaacaaacggacgtttgaagtatccggcggacagcgccagcgggccgccatcgcaagagcggtcattcataagccgtcactcattctggccgatgaaccgacgggaaaccttgattccaaagcgtcaaaagacgtcatggaaacgatgcagagcctgaatcaggatgatcatatcacggctttgatggtgacccacgatccggttgcggcaagctactgccgccgcgtcatctttataaaagacggcgaactgtttaatgagatttaccgcggggaaaaccgccaagtcttttatgagcagattcttgatgtgctgtctatgctggggggaaacgcaaatgacctttcttcagttcgcttataaaaacgtcacgagaaacaaaagggcctatcttgctttctttttaagcagcgctttttccgttttgattttctttacctttgcgatgttcctgtttcatccggcactaaaggaaggctacctgaataacatcgccagaaaaggcttaaccgctgcggaatggatgatctttgttttttctttcttatttgttctgtattcggttaacgcatttttgaaatcgagaaataaagaattcggcatcctgctgatgcagggtattacgccggtgcagctgagaaagctcattacggcggaaaacatgatcatcggcgtcatgtcgatcgcagcggggattatcggaggcttcattttttcgaaaacgttctttacggtcggcgcttatattttagaaatggacgcgctgcctctgtacatgccttggaaagcgctcggcattacggccggcggatttctgctcttatttttccttttatcgcagttcacgatcctttttgtcagatcaaatacggtgatcaaattaataaagggcactgacaagatcaagccggagccgaagccgtccgtgcttctgtctatattcggcatcgcctgcctgtgcggcgggtacggcatggttctgaaaggcaatgtccacgggactcaaccgttcatcattttactgcttaccgtcatcggtacgtatttctttttcagccaaagcagcatctggattctgcgcgcgctgaagaagtggaaaaccttttatctgcgcgggaaaaatgtcatttgggtttctgatcttgtttatcgtttaaaagacaacgcccgcctgttctttatcgtcagcattatttccgcggtagcgtttacggcgacgggcgtgctcgcaatgtacaaatcgaccgtcggggcggaagagtccgcttatgagatggagtatgtatcttacagcaataatccaaaagaacagactcatttgaaagatattgaccatgaactgaaaacacacggctttacgtataagaaagacaaaataaatgtttcctatattcgctatcaggaaggagatactgttccgcctgtttacatgatcagcgaatcggaggcggcgaagtacttccatgtcaagctaaacggcctgaaacatggcgaggccgtctatttcccgggcacgtatgaccggaatttcaaaaacgaagcgccggatcagctgaagctgctgaaccaaaaaggcaagccgtctgaccaaaaactgtcggtaaaagaagtcaaaaaaccgctgatctcattgaatgccatcatcgcggtgaacgatcaaacctttgatcagctgaaatcactcggtgagaaagcgtcattatacggctacagctatgatcattggaaagacagtcttgggatcagccaatccttgaaaaatgagatttacggcaactatatcgacgtccattctgattttatggcaaaagccggcacctactatgatacggtgcagctgccgagcctgagtttattcatcggcctgtttatcgcgatcgtcttctttgtcgcggcagcaagtttcttatatttcaggctgttcaccgatttagatgaagacagggagcgctaccgttcattggccaaaatcggcctgagtgagcgtgaaatggcacaaagcgtgacgatacaattggcgattttgttcttcttcccatttgtcattgccgtcatgcatacgctgtttgccttgagaacattggccgtggaaggctattccgatgtagcggggccgctcagtctgaccatcggagggtttttcatttttcagcttctgttcttcctcacagtgcggtcaagctatttgaaaaaaatgaacaagtaaggggagtgcacagatgaaaaaagcattggcaatcctggccgtcttggcggccgctgccgtcatatacggacttctcttttttcataacgatgttacagacagatttaatccgtttattcaccagcaagatgtctatgtgcagattgatcgagatggcaaacatcttagcccgggcggtactgagtatacattagacggatacaacgcatccgggaaaaaagaagaagtgaccttttacgccgcgaaagaccttcggaagaacgcgtatttgaaggtgaaggcgaaaggaaagtatgtcgagacctgggaagaagtcaggtttgaagatatgccgggctccgtacagtcaaaattaaagtgaacaggaaaaacggcacagtgtcatgactgtgccgttttttttattttttattttcttcagcccgtttgatcagcatgtcggtgatgatatccatctgtttgctgacggcaatcgggtcatacggatagaaggtgttgaaatcgttgataaagacacgattgtgttttacggcatcgagatttttccaaacggatgaatctttcagacgctcaaatgttttgctttctccattcggattgtaatcagtaatgaacatataatcagccgcatattgagggatgacctcttgggaaacctgtttcatggcgcctgttttcatgatgttttttttaattttggccggcgctttcaatccgagcgcgttataaacggcttggccgccgcggccggaattgtcattgaaaacccagatctcgcctttatccgtcgtttcataaaggccgactgtctcgtctttgccgatcacgtttttgaggcgcttttgattcgcttcggcttttttgttgaagtctgccataaagcttttggctttatccttcgccccggcaatgtcgccgaataggctgaccgtatctttcgtattctttgcggtgttaaaaggaatgacaatcgtcggtgcgattttcgatagtttctcgtattggtcttccttcatcagcacgattaaatcaggcttcagctgcatcactttctccacattgacgggattgccgatgtcagtaatgtttttcagctgttttttgataaacggatttttgaaagtccatgagcccgccccgacgacatttgcgtcaacggacagcagctcacccgcataaaagtcagtgacgatccgtttcggatgtgcgggtatgtcaatatttccttttgttgattcatatgtacgcatgtctgtctttcctttgcctgatgccgatccgttgttttccttcgcgccgctgcaagcgcttaatgcgaaaacaagcagaagtgccaggccgatcagccatgattgtttcttcataatgatccccctatttaagtgataatgattatcattattaatatagcaggaagacgtcattccgtctatgttttttatagaaaaccttccttgattatccatgttatagtagtaaaggaggaatgaatgttgattacgaaaagagggacttggtgggaagtgctgcacagctggtggctgctgctgactgctgctgacttttgcgctgaccgctttcttggcctttttctatatcggctaccgggctaagaacaaaaaatggctgaaatacggacttatctattttattattttagcaattgcttttgtgctgccgagcacgccgggcgtgtatatcgtgctgcctttatgggtcatctccatcatccacgggctgaaagtgcgggcggcttatttgatacagcttgatgtgtttaaacaaaacgtcgaagcaagagcgtttgaagcggtaaggcatgaggcggaagcaaaattcggcggaaaacccgctcatcgcattgatctgacaaaacagagataaaaacaaatgacaaagccggtatctcgcgctttgtcatttgcatgaccggcctattgctggtatgaatgctgctgaaacggtgtgtgatgctgtgtttgcgggaatgaagaaacattagcgtttgccatcggtgcaggcatgtgtccgcttacttcctgctgaagctgattgcacacattcacgatttgctggcatttctgaatggccgcttcatgcccctgcagcgcttgctgaatggtatgaacggcatgctgttcatggttaagcatctgctgaagcatttgaatgttttgctgttcctgctggagcatttgcttgtactgctgactgctttgctgtgtctgctgaataagctgctgtgctgtttggcggcattgctgcagctgatttccgctgtattggttttgatacatcatgaaaacctcctggagtgattgattttacacatttatcatgtgaaagaataggagaggcattcatgcaagaaaaggattcaaatatttacctgttatatacagagcggaatacaaggctcgggatggcctgtcgagctttgtattccggccctttttctcagaagccgccttctgtagcgtgaaaaggaatattgagtctgttttcgactgcgcgcaggcgctgattcaaacggtttaagcggcgggtatggatttcaatggactggctcagccgtctgatctgctcattcatacgcgtgatttcccggttttggcgctggtcttcttgtgagaggcgggtgagctctctcgtttgctcggcgttttgtctttcaagctgggcgactctccgttctaaacctgtcggctgccgctcttcggactgagggggcgcataataatagctttcctgctgctgatacggctcatactcaacgcggttcacttcgtattcctgctgctgagggaaataggcaggcggggtgtagtactgatatgggttcattcatcattctccttatctagtgaagtctttatacactatgtagtcaattgcacagtgccacggcatccgcctaagttacaggcgtaaaaaagcttcaaaggaaggtgatcatgttgcggaacatacggattttcatcatgacggttcttgttttcggatgcgtcatgataacaggctgctcgcaaaagaaagcagacgatacccctttttattacgggacatgggatgcagggctgaagccgggcccgatggacggggtcagatctgaaaccgtcacgtttacgaaagacagcgtgctgacaaagcaggtcattcaaggccgcggcgaggttgccatgccctcagatgtgtacaaggtgatctcacaaaacacggacgggacgatcgagattgaatacctcggccatccgcaccccgtcaaaagcacgttgaaaagaggaaaaaacggtacgctcatttggaagatatacggagaaacaaaaacaatgacaagaataaaaaccggcggggaggatgcacatgagaaataaggctgccgacagactcgttttgacgggtgtcatcgtacatatcattcaatggttttcactgttatggttattttttatgctttttgatcagttcgggcgttttaccatttacaatcccaatgtcgtcaacggaagcatgcagtctttttcattctttgatatgatgcgcgctcttctgttttccggcacgctgcggaatacgctcctgctgtttctgtttgcggcaatgctcatttacttgtgggtgaacgctctgtttatcctgctggaaatcgtttcttatatcatgatcaggcggaacagccgttcattatgggcatactttcccgcagcgatgggaataaagcttgcccttctggacatagcggccgtccctttctttgcggcggggctgatgctcttgaagcagaaaacagatgacggcggcgaacaagctgacaaggggaaaagacggccccgcatccggaggcaggcccggtatacgaagagaaggcggagaaactcgtccgtttgatttttcattgaaacgaaaaagcgatatgatgaaagcataagaagaaaaggatacaaaggagatgcaggatgtacaagttaatcgcaatagatatggacggaacactactaaacgatcatcatgaagtgacggctgaagtccgcggggcgcttgatgccgccaaagcggaaggggtcaatatcgtcctgtgcacgggccggccgatcggcggcgtgcgtcggtatttggaagagctgaacttacaggaagaaggcgactttgtgattgcctataacggcgcactcgtccaaaatacgtatacaaacggtgtcgtggccgagcagtcattaggttatgaggatttgaagtcgctttacgagctgagcttacagctggatactccgatgcattactttgacacagccaatctgtacacgccgaaccgggatatcagtgaatacacggtatacgaatcatacattacgaaagtgccgcttcatttccgcacgatcgatgaagtgccgaaggatattctgattccgaaagtcatgttcattgacgatccggacaagctggagaaagcgatcgcttccattccggaatcattcaaggaaacatacacaatggtcaaaagcgcgccattcttccatgagattcttcacccgaaagtcagtaaaggaaacgcggtcaagctgctggccgaaaaactcggcattgaacagaaagacgtcatggcaatcggcgataacggcaacgacatgtccatgattcagtgggccggctgcggtgtggcaatggccaatgccatcccggaagtaagggagattgctgattatgaaacgaaatcaaataacgaacacggcgtggcgcatgcgattcaggagcttgtgctgaaaaaataggcaccccatcagagggtgcttttttaccgcgtgttttggtgatatgataagcggagaggggaggcgcgacatggatcgtgaaaaacagcagctcagcatagaagcggcaaaactatattatcaatcagattacagccagcagcagatcgccgaacggcttgatctgtcacgccccaccgtttcaaggctgcttcagtacgcaaaggaaaaagggtatgttcaaattcgcgtcatggacccgtttgaggatctggacgaactcggcgcgaagctggaagaaaaatacgggctgcttgaggcgcacgtcgtcttttctccaagcgacgattaccaggccattacacattacttaagccgctatggcgcagactatatgcataaaaccgtaaaggacggcgatatactcggcgtaagctgggggacgacgatgtaccagatcgcaagccgcatggagccgaagcaggtaaagagcgttgaagtcgtgcagctgaaaggcggcatcagtcattccaatgttaatacgtactcgtcagaaacgattcagctgttcgccgaagcatttcagacgatgccgaggtatttgccgctgccggttatatttgacagcgccgatgtgaaacagatggtcgagcgggacagacatattaagcggatcattgaaatgggcagacaagccaatatcgccctgtttacggtcggaaccgtccgggatgaggcgctgcttttcagactcggctatttccgggaagaagagaaacaattgctgaaagcacgcggagtcggcgatatttgttcgcgcttttttgacgaggaaggcaggatttgcagcagcagcattaacggcaggacgatcggagtcgagctcagcgacttgaaaatgaaagagcgttcgattctggtggcgggcggcagcagaaaatgcaaggccattcacggtgccctgaaaggaaagtacgccaacgttttgattaccgatcagcatacggccaaaaaactcattcaagaattgtgacaattcatgaacataatttcaattaccaatttacatatgttcaaaattcggttattctaaacgtatcctaggaaaaaggaagtgcatacaatgtcaattgcaagtcaaatagaccatactgctttgaaaccgcatacacaaaaagcggatattttacaactgataaaagaagcaaaagaatataaattcgcttccgtttgtgtaaacccgacttgggtcaaactcgcagcggaggaactgaaaggcactggagttgacgtttgcaccgttatcggatttcctctcggcgccacgacatcggaaacaaaagcatttgaaacgaaggatgccatctcaaaaggggcaactgaggttgacatggtcatcaatatcggtgcattaaaagacggcgatgatgaagcggttgaagctgatatccgcgcggtagttgaagcatctgataaaaaagcgctcgtcaaagtgatcatcgaaacatgccttttaacagatgaagaaaaagagcgcgcgtgccgcttggcggtatccgcaggcgcagatttcgtcaaaacgtctaccggtttttctacaggcggggcaacggctgaagatatcgctcttatgagaaaaacagtcggaccggacatcggggtcaaagcatcaggcggcatcagaacaaaagctgatgttgacagcatgatcgctgcgggcgcgagccggatcggcgcaagtgcgggcgtctctatcgtgagcggcggagacagcggcagcagcgactattaatcagcagtgcggaagccgaaagcttccgccatcctctttctttgttgatgcataaaaaattgtaagcgaatacaaataaaaggagaacacatatgaagtatctcatcggaattatcggaatcattgtgtttttaggtcttgcctggcttgccagcaacggcaaaaaaagaatcagaatccggccgatcgccgtcatgctcgtgctgcagctgattctcggttatattctcctcaacaccggtatcgggaattttcttgtcggcggttttgcaaaaggatttaactacttgctggaatatgcatcagaagggattaactttgtattcggcgggcttgtgaatgcgaaacagacgacgttcttcatgagcgtgcttctgccgatcgtctttatatccgctttaatcggaattctgcagcattggaaggtcctccccttcatcacgaagtatatcggtcttgcgttaagcaaggtgaacggaatggggaaaatcgaatcttacaacgctgtcgcatccgcgattttagggcaatcagaagtctttatcagtttgaaaaaacagctcggttatcttactgaacagcgcttatatacgctttgcgcgtccgcaatgtcgacggtctcaatgtcgatcgtcggttcttacatgatgatgctgaagcccgaatacgtcgtgacggcgcttgtgctgaacttattcggcggatttatcatcgcttctatcatcaacccgtacactgtcagcaaagaagaggatttgatcgtcgttcctgaagaagaaaagcaatccttttttgaagtgctcggtgagtatataatggatggattcagagtcgccgtcgtcgtagcggcgatgctgatcggatttgtcgcactcattgccctggtcaacggcgtttttaatgcggtcttcggcattacattccaggcgctgctcggatatgtattcgcgccgtttgcgtttttaaccggtattccgtggaatgaagcggtgagcgccggaagcattatggcgacgaaaatggtatcgaatgaatttgtggcgatgcagacactctcatccggcgatttccatttcagtgcgcatacacaggcagtggtatctgtattccttgtctcattcgcgaatttctcctctatcggaatcattaccggtgcggtgaaagggctgcatgaaaaacaaggaaacgtcgtcgcgcggttcgggctgaagctgctgtacggcgcaacgctcgtcagcttcctgacagcggcgatcgtcggattgattcactgaacataaatgaaggacaggtgatagatcatgagaatggtagatcttattgtaaaaaaacaaaatggaaaagaacttacaacagaagaaattcaatttttcgtaaaaggatacacggacggaagcatccctgattatcaggcaagcgcgctggctatggcgatttactttcaggatatgacggatcaggagcgcgccgatctgacaatggcgatggtgaattcaggagaaacgattgatctctccgccattgaaggcattaaggtcgacaagcactctacgggcggggtcggcgacacgacaactctcgtactcgcaccgctcgtcgcggcgctcggcgttcccgttgctaaaatgtccggccgcggtctcggccatacggggggaaccattgataagctggaagcgatcgaaggcttccacgtggaattatcaaaagatgaattcatcaagcttgtgaaccgcgacaaggtagccgtcatcggacaaagcggcaatttgacgcctgccgataaaaagctgtatgcgctgcgtgatgtaacgggtacggtgaactccatcccgctgatcgcaagctcaattatgagtaaaaaaattgccgccggagcagatgccatcgtgcttgacgtcaaaacgggcgcgggcgcgtttatgaaaacggatgaagacgccgtgaacctcgccaaagcaatggtccgcatcggaaacaacgtcggccgccagacgatggccgtgatttctgacatgtcgcagccgctcggttttgcgatcgggaatgccctggaagtacaagaagccattgatacattaagaggggaaggccctgaagacttaaacgaactcgttctcacgctcggcagccaaatggtcgtattggcgaaaaaagctgagacattggaagaagcgagaacgaagctgcaggaagtcatgaaaaacggcaaagcgcttgaaaagttcaaagagttcctaagcaatcagggaggagacgcttctgtcgttgacgatccgtccaaacttccgcaggcggcgtacaaaattgacgttccggcaaaagaagcgggtgtcgtttcagaaatcgtcgctgacgaaatcggcgtcgcagcgatgctgttgggcgcgggacgtgcgacaaaagaggacgaaatcgatcttgccgtcggcattatgctccgcaaaaaagtcggtgacaacgtcgaaaaaggcgagccgctcgtcaccctttacgccaaccgcgaaaacgttgacgacgtgaccgccaaagtctatgacaacatccgcatctcagaaaaagcggaagcgccgaaactgattcatacgctgattacggaataagagaagaaaggcacatacctcatcagtatgtgcctttttttatggcatggttttatccaaatgaatgtcacggacggattgtttcggctgtttctttctcaaaaaacgaatgagatagcacaggatcatacaaggaattccgcagaagagggcgattctttgattgggatcaaatgcaaggcctacgcatgaagcgaaacataagatcacagcggcgatcggaacgagagggtataacggtgtgcggaaggtcagatccgagacgcgtccgccgtttttcacataatgttttcgaaataacagctgagacagggcgatgctcatccacaccacgacgccggcaaatccggctattgccacgagcaccacgtagaccgtgcccggggcggcgatgcttgagatcaaggatatgcaggaaacggccatgctggcgagcagagcattcagcggaatgcctttcggcgtgacttttttgaaccgggcgctgatcatgttttcattcgcaagagaccacagcatccgggtggaagcatacagtccggagttggcgaccgaaagcaaagccgttaaaatcacgaagttcatgatatctgcggcgtatgggataccgatttgggaaaagaccgcgacaaacggactttcaatcacaccggcttccttccaggagatcagtccggacagcacaaaaatggcgccgataaaaaagatgaccgttctccaggcgacatttcggatcgaacgcggaatatcttttgccggattggcggtttcacccgcggtaattccgatcagctccgtccctgaaaaggcgaagcttacggaaatcattgcgatgaaaaccgcaagaaagccgttcggaaacagcccgccgtgtgaggtgaaattcgacagcatcggagcttcacccgaaccgtgcaatgaaatcaaaccgaacatcgcggcgccgcctaagatgataaataaaaggatggtaacgattttgacgcttgaaaaccaaaactccgtttctgcaaacaatttaacggagaatgcattggcggcaaaaaggagagccgcgaaaatcgcgctccacatccagacgctgctgtggggaaaccagcgctgcatgaggataccggaagctgtaaactccgatcctaccgtcaccacccaattcacccaatacatgataccgaccataaagcccgtggacggcccgataaacgttgtcgcatacgtttgaaatgaaccggtcacaggcatggctactgacaattctccgagacactgcatgacaagatacatcatcaagccgccgatcaggtaagcggcgatcgtcccgcccggcccggcctggctcaatgtataccctgtgctcaaaaacagccccgtgccgatgacccctcccaatgaaatcataaataagtgcctgcttttcatcgtgcgctttagctgattgccgccttgatcaacatccatcgtgatctccccctttttgcgtggcgtgagaatcttccggcagccgagagcacgcgtgccggatttgattttaacgtgacaatttaaatccctttaatgcatgtaaaatgacgtgtgcggctgcccggcttgtcatatcgcgaaaatcaagtgtcggatcaacctcaacgatctcaatacccgagatgtcagcctcctgggctaaaaacctgaccgcctgaagcagttcctcggtatacagacctccggggccgatcgcgggacagccgggcgcatgagcttgatccagcacatccatatcaaccgaaataaaaatggcgtcggctcttttttgaacggccggcaagacctcttgtatcgttcggaggagccctttctcccggatcatctccattgtatgcacgtctgcctgccgttcttttacatattgttcgtatgccaagctgttgctgaactccctgatcccaagctgaatcaggttttgtccgcttatgatattttcatctaacagccggcggaatggcgtgccgtttgtcggtcctccgtcttctgtgttgcggacgtcgtggtgggcgtcgaattgaaagacggctgttgttcctttcgtttccgcaatggctttaatggtggaataactaatggagttgtcgccgccgagaatgacgggcacccagtcaggctggtccgtcagaatgtcatgaatggtccgataaatgtgttcgtgagatgtgacgacatccgtgacgtgaatctgaatatcgccgatatcgtaaagatggtcaatgacatgctcccgcagctccgcggaataagcggaaatcccgccgagcgcccggcggatcgcaccgggtgcaaagcaggcgccggaatggctgattgacgacttagaaagcggaacgccgatcaaagccggccctttgatcgtttgtcccgcccacgcttccgtcacatcgccgatccttgtcacatggcggtcgttgaagagggagccggctttttgcagaaacggatacttatccaagagcggctccctcccttgagacaaccgtctttccattcttgatgacacggcggacatgattgacgccgtaatgatacgggatatacatgtaattcggcgcttcccaaatgacaatgtcagccgcccgtccggctttaatttgtccggcctcttcgccttttccgatcgcatacgcggcattaacggtgacagcgtgccagatttcttccgcggtcatttttaaatgaagcgcggcaatcgacataatgagctggagattttccgtcggtgagctgcccgggttgaagtcagtcgccaaactgacccgtacgcccgcatcaatcatctcccgggctctcgcataagtgtgtttgccgagatagaaagtcgtgcccggcagcaggacggcgatcgttccggacgccgctagcttttcgatgccttcgtcagacgcccccaccaaatgatcggcagaaacagcatgcagctctgccgccaattccgcgccgccgagcgggtcaatctcatcagcatggattttcaggccgaaaccagcttcagacgcctttttcaggtagtcccgtgactggctgacggtaaagacgcctgtttctgtgaatatatcggcaaattgcgcgaggcctttttcttttatttcaggcaaaagctgcagcatgcgattcagaaattcgtcagggctgttccggtactcaggcggaatggcgtgtgcccccataaaagttgtgacaaggtcgaccggctggcgttcgcccagtttcttcgccgcggtcagctgtttcagttccgtgtctttgtcgagtccgtacccgctttttacttctgccgtcgtgatgccgtataacagcatgcgtccgaggtgaaaaagccctttttcaatcagttcttcttcggaagcggctttcgtgtctttgaccgttgacaaaataccgccgccttgcgccaaaatatccaaataggacatgccctgaatttttaaattcagttctttttcccgggaccctccgaatacaagatgggtatggggatcgacgaggccgggggtgacgagccgtcccccgcagtcgatgatgtctcttgcctcgtatccttcctccgctccttgatgtccggcaaaaacaatgcgcccgtcgtgaatgccgatgacggcatcttccgtgacatgaagatcctgcatgcttccgcctgatcgggggccgccggattccatcgtcagcagctggccgatgttggtgagtatggtatctatttgtttcggcatgttaccgctcctttttcatcggtatcataatgtcttgttcctcggcgacttgagccgctttttcataacctgcgtccgcatggcggatgatgcccattcccggatcgcttgtcagaacgcgggaaagccgctgttccgcaaggatgctgccgtcagcgaccgcgaccattcccgcgtgaagggaataccccatgccgacgcccccgccgtggtgaaaagaaacccagcttgcgcctgaggccgtgttgatcagcgcgttcagcaccgcccaatcgccgaccgcgtcgcttccgtctttcatcgcttctgtttcccgattcggagaggcgacagatccgcagtctaaatggtctcttccgatgacgatcggggctttcagctcgccgtttctgaccaattcattgatggcgagccccatcttttcccgttcaccgtagccgagccagcaaatacgggacggcaggccttggaatgtgacttttttctgtgccatgtcaatccagcggtgaagggcttgattttctggaaacagctcttttaataaagcgtccgtgcggtatatatcttcagggtctcccgacagcgcggcccagcggaacggcccttttccttcacaaaataaaggccggatgtaggcgggaacgaatcccggaaaatcaaaagcatcggcgagaccctcatctttggcagcctggcggatattgttgccgtaatcaaagacgacggcaccttttttcttgaaggcgagcatggcttccacatgctttttcatactctgcttggaaagccttacgtataattcaggctgatcccggcgcaggcggtcggcctcttcaagtgagtatcctgccggaatatagccgatcagcgggtcgtgagcggaagtctgatcggtcacgatgtcaatatggaccccgcggttcaaaagctcatgatgcacctcagccgcattgccgagaaggccgatcgataaaggctctccggcttgtctggctgcttcggcccagcgcagcgcttcgtcaattgatgctgttttacggtcgcaatagtttgtttcaatgcgtttatcaatccgtgtttcatccgcttcaacggcgatgacgacgccatcattcattgtgacggacagcggctgggcgcctcccattccgccaagtccggccgtcagcgtaagggttcctttcagactgccgccgaaatgctgtctcgcaagctccgcaaaggtttcataggtgccttgcaaaataccttgtgagccgatataaatccagctgccagccgtcatctgcccgtacatcatcagcccttttttctcaaggtcatggaaatgctcccaatccgcccatttcggcacgagaaccgaattagccagcaggacgcggggcgcgcggctgtgcgtgcggaacaatccgacaggttttccggattggatcagcagtgtttcatcatcttttaacattttgagggaacgctcaatcgcgtgaaaagcatcccagtttcgtgcggccttgcctatgccgccgtatacgatcaaatcctccggcttttcggcaacctccgggtcaaggttgtttcggagcatgcggagcacggcttcctgctcccatcctaagcattcaagttcggtgccgcggccggcgcggattgatttctttacatcagtcatcttgtaagtcccccttcattggtcatcagtttttggtgatgctcattcggcagaaaagactccttcttcagccagtcactcagatgctcgatgtcataagaaaacacgcggtcttcttgtatggacggcacgatgtttctcatttcgtgatagagctgttttgtgtacgaggcgcaatgttccgcaccccggtactccacggcctgcagcgcgcaaatggcttcaacggcaagcacccgtctcgtattcgcaatgatctggtaggcgtgccttgaggcgatggttcccatgctgacgtgatcctcctggtttgccgatgaaggaatggaatcgacactggcgggatgggccagggttttattttctgacacgagggaggccgccgcatattgcatgatcatcgctccggattgtaagccgggctgcgggctcagaaagggcggcaggtcattcagctgcggattcacaagccgttcgatccggcgttcagaaatattcgcaagctcggccgccgccactttgagaaaatccatggcaaaggcgatcggctgtccgtgaaagtttccgcctgagatgattttggcgccgtcttcgaaaatgagcgggttatctgtcgcggcattcatctcaatttctaatttttcttttacataggctaatgtctgccatgatgcgccgtggacttgaggaatacagcggatcgaataggcgtcctggacacgcagctccccttggacggtcgtcagcttgctgtctgacaagtaatagcggattcgctctgcgacatccatctgttcctgataaccgcgggcggcatgaatgtcctcgtcaaacgcatcgataatgccctgaaggccttcgatcgttaagctcgcaatccgttccgactgataggccagcttttcggcttcgaggtaagcgatcagccccatcgcggtcatggcctgcgttccgttgatcagcgcgagtccttccttagaggtcaggacggccggctgaagggttgtctgttctaaagcatgagctgtcggcatccgggccccttcgtaaaagacttcgccttgaccgataagcgccagtgcgagatgagaaagcggcgccaaatccccgctcgcccccagtgacccttgctgcgggatgaccgggtgaatgcgatgattgagatacgcgagcagttgatcaatcagctcagtccgcacgccggaaaagcctttcagcagggcattggcgcgcaaaagcagcatggcccgcgatacagattccggaaacggatcaccgacgccgcacgcgtgagaaagaatcagattcagctgcagatccgcggcgtcttctttttgaatcagcacatcgctgaacttgccgaatcccgtcgtaatcccgtaaatggtcttctcctcttgaacgatccgttcaaccgccgccctgctttttttcacacgttccatgctttcggcagatgcttgaacctcttcaaaatcaaacagcacacgctgggcatctgcggttgtcagtgaggaaccgtctaacgtcaccatcatttcaaccccttttcctttactttgataaagcgcccatacaaaaaggagctatgccatgaaaatgatatttcacgcatagccccctatcatctgaaatctatgggctgattcatatgtgattaattccgactccgaatgtttcgtgctcaagccccttaatcggagctccgatcgtgccgtaaagtgaaacggcgatccaatcgccttccgcctcgctttcatacggatttccccgcaagacggcaaacttcaggcccacggtacgaagcagcgagccaagcagcatttcgcccctcgtcactccgtgcaaagcttccattgtagcgtgatacagcgcatgtgattcgcgataaccctcagattgaatgacgccgctctttttggaagcggtttcaattgcagctaccaccttatgcgcatccattgaacccaccctgccgagacagactttccagccgtcccgttccagccgtctgatctgctggttttcttcagtctcatgaagcagaagaaggacggataagcgcccgatgcggcggtctttgtgtaaggtcatatatgcttcactcaattcttaaatattctgataactagtaactgttttttatattaagtgtttgcgaatcagaagtcaaaactttttttccagtctttcacaaatcagattgttatcgaagtaaagcggtacatcgcgaagccggcgctgttgatcacatatttccgccatccgcgtcataaaatggagcgttgtcttgaaagcgttttaagaaaagaagagagcgaggagatttcagaaaatgaaaaccagtttctttcgtgtgtgcctggtctcagcagcggtcatcggattcactctgccgcaggcaaaagcccagcatccggttttttcagaggtcagcgtgcatgatccgtccgtcatcaaaacaggagatacatattatgtattcggctcgcatttggcttccgccaagtcgaaaaacctgatgcagtggcagcagatgtcttcaagcgtcaatcccaataatcccctgatcccgaacgtctacaccgaattaaaagagacattcgactgggcccagtctgatacgttgtgggcgccggatgtcgcccagctggctgacgggaaatattacatgtactataacgcctgtaaaggagactcgccgcgatccgctctcggtgtcgccgtgagtgacaaaatcgaaggaccctacaagaacaaaggcatctttttgaaatcgggcatggaaggaaaaagcgaagacggcacgacgtatcatgcaaacgttcacccgaacgtcgtagatccgcaaacgttttttgaccataaaggcaagctctggatggtgtacggctcttactccggcggaattttcatactggaaatgaatccgaaaaccggtttcccgctcccgaaccaaggctacggaaaaaaacttctcggcggaaatcacagcagaatcgaaggcccgtacatcagctacaatccggaaacgaaatattactatctgtatctgtcattcggcggacttgacgcagccggcggttatcatatgcgtgtggcgcgctctaaaaatccggacggtccgtactatgacgccgcaggccataacatgcttgatgccaaaggaaaagacggcagtttcttcgacgacaaagcaattgaaccgtacggggtcaaactcatgggcggctacagcttcgcctcacaatctgaaaaaggcacgggctacgtatcgccgggacacaactccgtgttttacgacgggaaaacgaaacgatcatacctcattttccacacccgtttcccgaacagaggcgaagagcacgaagtcagagtacatcggctgtacatgaacaaagacggatggcccgttgcagcgccataccgctacgcgggagaaccggatacacagatatcggcatccgccgcatccggagcctacaaactcatccagcacggaaaagacattacagctacgatcaaaaccccaaaaaatatccggcttaacaacgacggcaccatttccggggaaatgaccggaacctggacaaaaacggacagcagcaaagcccgaatcaacctgaacggcacaaattatgacggcgtcttcctgaaagaatgggactcagcgagagagaaagaagttgtgacgtttagtgtgctgagcggtgatggggaggctgtttggggagtgaagtaaattagcacctactccattttggagggtgcttttttcttgctaattaggagaatgaccttctattgcttttaataaaccatttgaattatgatggattcaacctctatcgtttacagtgaacagtataaaattgaaaaatttgaatacatacctaagaaaaaacgaaaggaagtttaattttgaaagaaacaataaaagtagccgccgcagtcatacaaaatgaaaacaatgaaattctatgtgctctacgttctccaacaatgtctctgcctaatctgtgggagtttcctggtggaaagcttgaagaaggggagaatgcacgagaagcacttgtaagagaaattgaagaggaacttgactgtaaaattgttgcgggcgatgtaatagccgatattcatcatgaatatgagaaggtcatcgtcaatttaatttcaataaaagcgaagattgtatcaggggagccggtagcaaaagagcatgcggaattcagatgggtgcctatacgtgagctagaatcactagagtgggcacccgctgatcttccgaccgtatctgccttaattcgttaaatccacatacaagttttctgggacaggctgatggagcttccatttgacattcattggcttgtctccgtggcttgatacgtaatccgcttctcctacataaataaatggtaaagtgatgttgtgcatttcagtgaatttcctcacaaataaatgaatatggtatcctttttccttatggtgaataaagttttgccctacgcttgatgtatgtgaggtttggttttgactttgccagtgaaaatggctaggatcaataaaataatctttatatagcaaatgatcttctactttttctgacttattcaaattgataaagattaaatagtgatttttaactctacgtacaccctctcgccaagtcccttcctgatcagttgactgaaaaagataaatgagctcatttcttgtataggtttgatacattgtaagcttaatctcttttgaagcaagggcgtctatattgttcatacgtctaaattcaatcattccatagtggacgcgctccttaatatacggtccgaataatggatcgtttaatatctcgctcacttctggatctaacttgaatgtatcaccttgtaatgtaccaaagcgccaattctgtttttgatctgatttcgttaaacgctccattgctcgctgaatgaggtcatcatgtgtatctgttgtgatttgaatatgaaactgtttttctaacgattcttttacatcttctattgtgatgatatttttgtgaaaaccgctctgtaaaattaaccattcataaggccatttaataggtaattgctgttctaattttgctactatccctacaaccaaggggttattgagaattccttcatctgtaacattcaaatcgtccattttctttttggtctgtacccacgatttgtatttctttataaaaaaggtaagcccaggtgcctgttcagagtatagaaaatcaattaattctggagagcgtcctagctcttgtttaaattgcttgtataacgttttcagcatggcatctgaatttagtttaatatgatcgatcttatttaaaatttctttcttcgttacggctgaaaggtcaacataagatcccccaggtaaatctgaaaactcatgcgtcacggccactcggagggaatctttatcaaacgatttttggcttgtttgtccagatagtgcgagtggaataacaaatgacttttgatagtttccgataaaatccagtatcgttacaaactctttgtcgtctgtttttctaagcccccgtcctaattgctgaatgaaaatcgttggtgattctgttggtctaaggaacaatagtagattgagttttggaatatctattccttcgttgaaaatatctactgtaaatataagttctaaactgtggtgcgggtcctccaaatgacgaatgacctcttgtctttttgcaggagaatcatttcctgttaagtaagttgtataaaatcccaatttattaaattcatcactcatgtatattgcgtgttcgacgtttgtacagaaacctaagccaaccattttctcgccgtggaatccatacatgttgatcatcttaatgatatattctactcgtttatgagtttttaaatgatctactagcgatttctcttcgtacagtccatttttcacttttactttttcgtaatctacagtatgatctgaaattccaaaatagtgaaatggtgcaagtagctctgcctttagagcatcgcggagtctaatttcataaacaacattatgatcacaaatctgaagcacatctttaccgtcaagacgctctggtgttgcagttaaacctaataaaaactttggtgtaaagtagtttaatacagcttgataggtagatgcttctgcatggtggaattcatcaatcacaatgtagtcaaattcatctgttgaaaaggattccaatgtttcttttttatgtagcgtttgtacagtgctaaataaaaaacgcttatctctttcttttttcgttccactcaataaaccaaaatcttcatgattattggtgactttctggaatgtttcgattgcttttgtaagtaactcttcccggtgggcaagaaaaagatatttatttggtttaaattgctcaaaatcaaatgctgctaaaaatgtttttccggttccagtggcggcgatgatgactgcttttgtctccccttcgtttcttgtttttttaaggtttcgtaacgcttccttttgcatggcattcggggacattttcgttttgtaaagagagttttgagcagcaaaggaagcacttaccttttggcttcctgcttggaattcctcataggcttgtaaaaattgttcgtcaacaggctgtgtcttttcattccaaacagtgtcaaacaaatcttttgtttgttgataaacggggagatatctggtttcaggtagtctaacatttaactcatacccggtcgtaagtgcagcttgtgatagatttgaagatcctacaatgacactatgctgtccagaacagcgttcaaataagtatgctttcgtatggaaagattttttatattcatttacaattttcaactcaacattttcaaattgaagaagatgtcttaacgctttcggttctgtaatacccatataggtagatgtaatgatgcgtacagggacatgtcttttagcaagctcctgaagcggagggatcaaaagctgaacaccagaccaccttgtaaaactaaccataaagtctacccgatccgccgttaacatctcgtgttttaatgctttgaaaaagttatcatgagtttgatgatttcctagcagtttcagacgatgtagagagaattcctctgaaataggaagttccatttcgtttaaactataaagcactgtggaaagtggtaatgaaaaattcgtatgttgtccaagctgagaggcaactttctcgctcagctgaatcgcttgttcatattgatcttgatccacaagtgtttgaaatgtctcgctcagttgttttgccgtatgtaaagtcaaaacctctgcatattctttagggccaaccggttgaatgcgatgtgatgttggataaagtttttgttgttgctgaatttcctcatggaagcctctatgatttctcatcataatctccttttttatatcaataattccattttatcactactcttaccaataggtaatactaaaaaagaagagaataaagtcctatttattaagcgtttaaaaaataacgctgaggtagtttggtggagtatggagtattcttacattgaaaatggggttactgttgaggtaatgggcttgaattgactgcatgatctagtatttgctcttatcaactggaagtaggtactactttaaccgttgtggacaaactagagaagtgtgaaattaaagtagagaagaggaattagggcgcaatttaacttaaagctactttatcagaggtacttaacatgagggttcttttagttaatatagtagatgggaacaatattttaatgcctttatatatttgactagtatatttttaaaaatgtaagcgttgatacccaataaatccagtgctaaagtatacatatcaacccaatatcattcacctaggattgttactgcaaatcgcaggcaaaacctaaattgcgtcagacaggggaagacccccgtgtgctgtgcagtttgggttttttttatacccttttttcggaggtgatgctgatttcataacaaaaaaagccggagaaaggcgggcacctttcgtccggcggttcccccatttttaaggaggtatactcatggactatcataaaatatcaaaagagattttacaacttgtcggcggggaggagaatgttcagagtgtcatccattgcatgacgcggcttcgttttaatctatatgacaatgcgaaagcagatcggagcgggctggaacagacggaaggcgtgatggggacaaatattagcggcgggcaatttcagatcattatcggcaatcatgtgccgaaggtgtatcaggctttgatggaaagcagcgggctcagtgatgaaagcgcaaacaaaacttcaaagcagaagaaaaatgtgctgagcgccgtgtttgatgtgatttccggcgtgtttacaccgattctgccggccattgccggagccggcatgataaaagggcttgtcgcgctagcggtgacattcggctggatgtcggagaagagcgagactcacagcattctcacggctttcggtgacggtgcgttttattttctgccgcttttgcttgcggtaagcgcggcgagaaaattcagatgtaatccgtacgtggcggccgctgtggcgggtgcgattctgcatccggatttaacggccctgcttggagcagggaaaagcatctcctttatcggtcttcctgtaaccgctgccacgtattcatcgacagttatcccaattttgctggcgatatggctgatgtcctatgtagagaaaggaattgaccgaatcacgccttcatctttgaaattgattgccgttccgatgcttacgcttgtgatcgtcgtgcctgtcaccttgatcacagtcggcccgctcggcgcgattctcgggaattacctgtctgtcggcgttaatgatttgttcaatcatgcgggcattgccgcgatgattctgcttgcaggcacattttcgctcatcattatgacggggatgcattatgcgcttgtgccgatcatgatcaataacatcgcccaaaacggacatgattacattctgcctgcgatgtttttggcgaatatggggcaggccggcgcgtcatttgcggttttcttaaaatccaaaaacaaaaccttcaaatcgctggcgtttacgacgggcattacggcattgatgggcattaccgaacccgcgatgtacggcgttaacatgagattgaaaaaaccgttcgcggcagcattaatcggcggcgcggcaggcggagctttttacggtgtaacgggcgtcgcttcttacattgtcggcggaaacgccggtctgccgagcattccggtctttatcgggccgacgtttctttacgcgctgatcgggctttttatctcgtttgcggcgggtatggcggcggcacttctgatcgggtttgaggatgtacagtctgaacgggacaaagcatctgaaacgccgggtgtgacggcaggcggagaaatcattcacagcccgattaaaggcgaagtgaaagcattaagcgaagtgaacgacagcgtcttttccggtggaatgatgggaaaaggttttgcgattctgcctgaagagggcgcagcggtttctcccgtagaagggagggtgacagccgtatttaaaacaaagcacgccatcggcattacgagcacccggggagccgaggttctcattcatatcgggcttgataccgtccggctggatggcaggcattttgagatgcacgtcaaagaaggcgatactgtcgcgccgggagatctgctgattacttttgatatcgacgagataaaggctgccggttttgacgtgatcacgccggtcatcattacgaatacggatcaatattcatttacagacgtgaaaaaaagcggaatggtcaaaccgaacgaagcgcttctggcgttatcctgaaaaagaggtggagaaaacatgaagagatttccggaaggttttttatggggcggcgcaacggctgccaatcagattgaaggagcttataaagaaggaggcaaaggactttctacggcggatgtctccccggacggcattatgtctccgtttcatgagacggacgatgcgctgaatttgtatcacgacgcgattgatttttatcaccgctatcaagaggatatcgccctgtttgcggagatgggctttaaagcgttccgcacctccattgcgtggacgagaatctttccgaacggcgatgaaacagaaccgaatgaagaagggctgcaattttacgaccgtttgtttgacgaattgagaaaacatcagatcgaaccggttgtcacgatttctcactatgagatgccgctcggtcttgtgaaaaactacggcggctggagaaaccgccaaacggtcgatttctatgagcggtacgcccgcacggttttcacccgttataaagacaaggtgaaatattggatgaccttcaatgagatcaacgtcgttcttcacgctccgtttacaggcggcggccttatattccgggaaggcgaaaataaacaaaacacgatgtaccaagcggcccaccatcaatttgtggcgagcgcgctggcggtaaaagccggtcatgagatcattccggattcacagatcggctgcatgatcgccgcgacgacgacgtatccgatgacgccgaagccggaggatgtatatgcggctttgcaaaaagagcggagcacgctgttcttttctgatgtacaggcgaggggcagctatccgggctatatgaaacgcttctttaaagaaaacggaattacgatcgagatgaaggaaggagacgaggcgctcctgaaagaacatacggtggattacatcggcttcagctactacatgtcgatgacggccagcacggcgcctgaggatctggcgcaatctaagggaaatcttctcggcggcgtgaaaaacccgtacctgaaatcttccgaatggggctggcagattgatccgaagggcttgcgcatcaccttaaacacgctgtacgaccgttatcagaaaccgctcttcatcgtcgaaaacggactcggcgcggttgatcagccggaggaggacggaaccattcaggatgactaccgcatcaattatctgcgtgatcatttaatagaggcaagagaggcgattgaagacggcgtcgacctgatcggctacacgtcgtgggggccgattgacctcgtcagcgcctcaacggcagaaatgaaaaaacgctacggctatatctatgtcgaccgcggcaatgacggaaaaggcacgtttgaaagaaagaaaaagaaaagtttttattggtttaaagacgtcatcgccacaaacggagaaagtctgtaagcgcaatgttccggagaaagccggcaaaattgacattcagcaaagagaggaggacaataaaagcagaaaggcgggattcatatgtttaaaaaaattcttgcagcagtagacggttcagacatgagcaataaagccctggacgcagccatccatctggcgaaagaacagcaggctgaactcaccattctctatgcgggacgtgaagccgttgtctccacatcagctttaaccgggattgtctatgttccggaaaacttcattgaagacatcaaacatgaagtcgagcaaaaaggagcagccattctggaagatgccaagcagaaagcggcagaaagcggagtaaacgcggaaagcctgtacgtccaaggcgaacctgcgcatcaaattttaaacatagcgaaagaacagcatttcaatctgattgtcgtcggaagccgcggaatcagcggatttaaagaaatgatgctcggaagcgtgagccataaggtctcacaattgtctccttgtcctgtactgatcgttcattaaacagaaggccctgctgatgcggggcttttttcatgagaaaagaccgccggctttcgaaaaatagggtgaaatcttcctctgaatcaagtaaaatggctgttagtatttgtctgaataaacagtcaatgatatgggggaagcaaatcaatgcaagctgaacaaacatcaaatgccgtcatcaaaatggtcatttccatggtcattttcggatcaatcggctttttctcagaacatacgaatgtgccttcaattgaactggtctttgtgagatgtctgtgcgcctcattgtttctgggcgtctgctggtttggttccggacggtaccgcaccgaacaatggaaccggcgggaggtgctgcagacactggcctgcggattttttctcgtgctgaactgggtgtttttatttaaatcatttgaggagacatcagtgacgatagcgatttccgtttatcatttggctccggttctcgtccttcttctagggagccttatataccgggagaaactgcatattgtgtccgtcagttccatcgtgatttgttttctgggcaccgccctgatttccggcatcaacggaagtacatcattttctcagctgatgggatcgggtattatttgggccgtgctggccgcccttttttatgcttttacgacactggccgggaaaggcatcaacagcctcagcccatacgccgtcacctgtttgcagaccggattgggcgttatcattcttcttccgttcgtccgtttcggcgctttttctgatttgtcgcatgtgaactggatcatgattgtgtcgaccggtatcattcatacgggaattgtgtatttgctcttttttgacagcttgcggtttttatccacccggtttatttcaatcatcgtatttcttgatccggcggtggcgattgtgctcgacaccgtatttacgggatttcgccctgacctttatcaatctttggggattgtattgatttttgcgggaatggggctgtccctgattcgaaagcaaaaagccgtgccttcggaagctcaggcagacagcacccgtatataggcggccgtatcggctgctttttttgttttggggcttttcagccataacgaaaaagcagacaaacagatcatggaaaaagaggatagtaattgtataatacttcttgtgtttacaatttaagaaattaaaggagtgaagggcatgataaaaaagacgcgtcatctcgctttcttggctgcattcggatttgcgctttgtctggccatcgtatgttccgcatcaaagcaggcagaagcggcagcggcttatccggatgtgatgcagggacttaccggattcgcgggcaatgcgaaggatcataacggtaaagcaaaatccgccgtatcgggaggccagggcggccccgtcgtctacgtcagcaatctcaatgatttgaaaaacaatgcgggcggaacggatcgcaaaaccatcgtcatcacaagtgatatttcttccccgggtaaagccgtcgtgacagtcggcgccaataaaaccatcgtcggctcttataccagccacaggctgaccaacatctatctgaccaccggctccggctcaaacaatgtgattttcaaaaatctcattatcagccatagtgccgccattacaggcaacaacgacattccgatgtacatagcgaacggacagaattactggattgaccacgtgtggtttgaaggacacagctacaatccgaacagccacagtgatttgggaaagcttctgtatgtcggcgccaaagcggattttgtgacgctgtctaactctaaattcacagaccatctgtacggcctgattctcggttatccgaatgatgataacgaaggacgcaattatatcggctatccgcatatgacgatcaccaacaactattttaataacgtctatgtgcgttcaccgggcctgatgagatacggctattttcacgcgaaaaacaactatgtgaccaatttcaatttaggattcaccattcatacaaacgcgactgttttctcagaagccaactacttcggtaacggaaatgaaaaaggcggaatgatagacgactacgggacggcccaattcaccgacaccggttcattcccgtcgctcaaagccccgaaatcaccgcgcaccggctggaatccgagatcaaattacagctatggcaccctttcagcccaggacgccaaaaacttcgcccaatcctacgcgggagcgcaaaatacaaatctccgctatccataatacgaaaaaccgccggcagccggcggtttttttatatgaataaaaggttcaaaatccctataatccttaaaataaccttaaatacctaggaaaatattgataaacaatttcaataatattactattgttaagcctatattacaaaagaaggaggagaacctatgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgacattccggccgcagacccggaaaaagatcttccggcggaaaaagcacccgagcagatgccgtttaatcaaaaagatatcaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggaagagttcagaaaccgagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggtgcggaattgccgatcaacccgggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatccagccaaacgggttatgtcaatctcatatgggataaagtcaaaaacgccaaaggctacaaaatcaacatctacaacggaaaagattatcaatcattcgatgtcggggataccgatcattggacgacccaaaacaaacgcatctggccgtcagccgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagtcttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgaccaatttgtattaaaaacaaaagatcagacgaacgcttatttcagcaaaaaaggcggcaagctccaaaaaatcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataatgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgacattgcgtacgacggacttgatgccgtttctgaaacggatcaaagcggaaaatcctcatccgccgccgtgtatgacaagtacggaaatctcattcaatcaagcaaagagctggcagcttcggcgagtctgctgaaagacggcagctttgaaggaacaaagcttggctggaatctcactgctacgagagacagcggaagcatcgcatctgtaaaagcaagaagcggcgcgctgtccggacaaaaagcattggagatctcgtcacaatccgcttcagccggaacagagcacggccatacgtccgcaacgcaggaagtgcagcttgagccgaatacgacgtatacactcagcggccagatcaaaacggatctgacgaaggcgagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacggggatgtccaaggctgacggcgtaaaatttacgaatgacaatgattacgctcttcaggctgacgtcacttatgcggacggcacgacgggcgtctacaccgccaaattcccgcaggggacacaggaatggaaccgggcagcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattacgatgaaaacggcaatgtccagacattcatcagcggcaatgaagtcggcacgagtttttcatatgatgagcggaatctcgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaatgttaccaccacaaaggacggcgcaagcaaatcagtcaacgcatccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtagtaaatgccggatttgcagcctatgatggatataaggcctataaatcaggtaaaggatggagaggtgcagcctgggcagcggcttcgaactttgggcccgggaaagtgtttaaaggtgctaagaaggctttgggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcggatcaccaaccagtatcaaaattaaggaagaaaggccagcgacaaaggctatatcctcattgtcaaacttgttcacgaaaacaaggaggatatactagtgctattctgagaaaaagacatcaacggaggtgaggatgttgggtggaaaaaaagaagccattctcgcattgcttaacgattcattcaataaggaagagtttccgtttcttgataatgagaattttgacttcgcaaaagggaagctttcgatttttattgaaagagataactggcttttaacgttccagctgtttggattgtcgagattgggaccagctattgatttttatgcggtgggtaatcaattaacaaataatgaagtaagttttttagatgatgaaccgtttttatttgcagatgaaaaaggaaatttgctggaattggaagatatagaatcgggttttacaagtaaacaaatcaatgtgtctcttagagagaaaacatttcaattttttattgagcaggaaataaaagataagatttccccaaagaatgaatggattacatgtttgaggcatatgaccaaaaatagattatttcttgacacactttggctgacgaaacaagaacaactggaaatagcgggtctctcttcggagtatgaacaattgtattcaacagaattatggatgcatccagaaggagaaaaagatttgcctagtttgtctcctttctttcaatcaattgccgaagcaatttcccgtcaagagatagcatatattcaaaaacatgatgatggtaacacagagtggccaaaatgggcacacacagattctgttcaatacttttgaagatattatagacatgcagtaattggaaataatccgttatatattaaataaattattatgtggaagataaaatataaaaataatttaataaggagaatgaattttgattaaaagtaaagaaattcttagcctattagatgatgaatttagtgaattaaaccgaccaatttttgaatggcgtgaatctaattatgttgggagtaaatgtaccttattaagattaaatgatgacaattggttactggcaattcattgcttcgaagtagattctaaaggaccttttctggctattcatacctatagtaactgtttttcagacaactacaaatcgataataattgatgacttcgccttaaagactgaagcaggtgagaaaataacatatagtgaaagtgattttcaacaattaagcgaagtagtggaaattgaaattaaagagtctcgttattgcgtaaatattcaccaaagaaatgaattccaaaagagtacaaaagaaagggcttggaaaacttatttcaggaatttgtttgaggatgcttcttttagagaggcgctttggataaagccaaaaaaactattaaatatactggatctaaaaagcgaagcagaaggagtattcgaaacagaggattgggaatatcctgattacctaacagatccaagccaattaatttcttttcaatcatttgcgcaatatcttgaaaaaggcgcaggttcagttgatgtaggtgatgtaaataataactggagggagtgggaggattacgatattgagtagttgatgaaggaaacctttttaacctctgggcgtacagaattcagacacgatattattcagggaatgagcggtatgaaatagaaaagaaagaaggccgttctattgggatattgggaagaagaatataaaaacaagaaagttttacttagtgatgaaggcttagatatatgttttgatgctgtagagaaattttgtgaattatataagagggagctggatagagaaccgatattagaagaattcttagcaactttagttaccgtaatgaatacaaatggagattcttctttcacagagttagttgataagcgaatagtagaaataaagccaacgaccaggaaagtgaaaccaatagctaaagtaacaccgggagctgttattcaaatacctttggataagatcgggaagtatacttatgcttgggtcattgaaggtgatctatcaaaaaataaagacgatgacattcttattcagtattataatattttcactgaaaatacacttagcagagaagaaatcattcgtctaatgaaagaagaaaataagaaaatatttgcggctaataccgggcacacaggttttctgcaaggagattggaaagtaatatccaagatgcctcaagagataatagagaaaaacagtcattctcaattgaaatttgttttatatgaagacggtaaatatctcataagtgaaggcgattcatttgcatcagaagatgaattagcagaggcagatgagaaaacaggcaaggacatccctaacccattaggtatatttggacattcatctgtagaatctattctctataaatattttgcaggaatgtcaatggaagaaatcataaagaatgaattgtaaaagactgattccttacattcttgcaattaatgttaaaggatacttactgtacagatactgacagtagtaaatgttttgaatgctgaacgagacataatatgaaaaaaatcaatctcaactctattacacaaaaagaaatcttacaaatagaaaaacaatttgaacgaatcgcattaaacaaaatagaaaacaatcaagaaaagtttagaaaaatgggattgaaaattgaagctgcttttggaagagtcggagacgaaaaagtaataggaaacgaagtacagccctcagattgttttgagaatagttataactcattaatatttttttctgtagcttatttggatggtaccgactttcatgataatgaagatggctattgtatagaccatttagatatatggatttgtgaaagaaggttgttttcggggaaagtgggatatttaacagatttagaaagtgaagaggaaatagcaaaagaaatccaagataagataaatcaattgtttttagaagctacagatataataaaaatattaaaagagtaatttatggcttcttttagttatttttagagaagagatttagagaggttaccaacctctcttatcttatatgataaaaaccaaactacacacggaacacgtgggaataacatatcgctgagacgaagtaaaagacaagcgctaccgctaacaggctaccaatacgacgaaggaacttattctatctcatacgatttacagtgtataaaagatagaaggagagaattaaatgtactatttttatgaaatatcaactctcaatgactatgattcggttgaaaaagagtataaaacaatagaggatttaatatttgttatattaaaaaatatggaaaataaacaatacgcaatgtattcttactctgtttcaaataaagatagtgatacttgtatattctcagcgagcttaaaaacaaatactttgtttaataaaaaaatctcatttataaaaacctcagcagaagagtacaaaaatacaataattgcgcatgaaaatataatcttattggaaaaagatgttgagttaaaagatatattaaatggagcccctttagcagagaaaacaattattaaagatttactggattatgttctttatcatatagaaataacagattccgagacaatcagaataggatctagacataaggaaaatattataaacattattaaataatggcattaaataaaaaatagatgagcctgttgatcatcttttggttaacaggctttttaaaaaaaattatagataataagtgggtaggtgattagaactgagacagtaaaaggtgacaatcgatttaaacttagcttgaattccagagcgtcattcaaatcatttactactaaattaaagctattaagtagagaacgaggagacagcatggccaaaatcggagacggttgtctggaacttgaaataacaccgagaaggtatcatgaggcgaaggatgatccatttatctcaacaacgtttgaactgttggaacataataaagcaatcgcccgcgattactctgccgttttattagaaagtgaatataaaatgctgatatcagatattgaagcattatcagcaggcaatcaagacaggatacgtttagaaacaattgaaccattttttatcctaagtattgataaagaaaacgaacattacagatttatcattagatttatggagaatcattcaaatacaaccttctataaattgaactgtaatgaagaaaagctagaaattttcgtgaagactttaaaatcagatctcaaagactccaaaactttattagggagataaacggtgtacaagacaattaatgaatgggtagattatatagacggagggtgcgctgtccttcattttgactttcatgtgtttaaaaaagagctttcacttaagattcaggtcgttgaaaataaagccgaatgtacgcataacattctttttcaaaatgcagcatctgtttattttagtgcagatattggtgatatgagattagaaaaaatagatccggaagaatacaattggcaagtatttgagatgagttaccacccggaaggaatcggtaatctatcaaatgctgtaattccggagtatcaatcaaatgctaattttcttataaatatgaacagcatgctgattgctgtagaagctgaaacagttcgctttgacgaccaatcattttatgcgtatcatccgaaatcataaataaacaaataagagaggttcccagcctctcttttcttacataacgaaaccgtttacggaggtaaacatgaacactcctttaaatttacaaaaagaatcattgagggctatagggaatctgaatgtgattaatccgcttaaatacaattcgatttattcatgtgatctagtgagtaaagatactttttctcaattaatgaatgacttagaattcgaaacagttctgatagaagtaatggcatcaccttcttttattgaaggatggaagaagaaggttgaaaagaaaatgataaatatgaatactgtatcgaaaaagttcattcatgttgaatgtgtcctaaccaaagaagaattgatggcagatcacttattggatgaattatattttttagcatcgatcaatgactttgtagttataatagcaaaccctgccaaaaataagtcctacatgaacctgaacactcaaaaggttgatgtaactactgaaaataatgaaaaaatcatttggtttgaatacgatgcagcagatttatatatcattgattaatttaatataaattccagattcctaatcaacggagtgttgctgatgttagaacttaccgcggagcgggttgggtcatataaaagagagcacatcatctatttcaatgcgggtcgggatgatcaagtgtttattgtgtcggtgcatgatcacaaagtaatattggaggttatgaaaggcagctctcttttaatcaaaaaagagttacacggattttctgaagatgcccatttctatctggttgattcgtatgatgacactatcgtgatcgtttacctggaaaatcatacgtgtcaattagccgtatgctgcgtaaacagtaataaaatcaatccgatttgttcttttctattaagcgccaatgtatttcatctgggtgaggatggattactatggatcggattaacggacgagggtatgtatgatgagagaaaccctcaagggaaagcgatatttgcttttcatgcagaagacagaacgttttattttaaagacgattttaaagaaatgatgcatgagtgctatgccgtacaatcgatcaaatctgatttgtatgtatgtttcgagggagaggattgctgtatcatcgggcattatcagattggacgggacagaattcgtactgttgcagaatatgtgctggacggcgatcaatactcctattgtgatcagctatccgtttcgaaaaaaagggtgctgctgattcagagtcacgaggataccctatttgcatttcataaagagaacaaaggcttatcagagactgacgtcatgatacacggtattgatagaaaaggagaaacaacgtacagagccgtacaggaccgcatgtttatctttcatgataacgatttatatctggtgaagtattgattacttctatgcagcatacatgccggcagaatgaaaatatcctgtaaggaagtgttcagtgatgagagaaaagttaattgacaagcttgaggaaaacaagaggcattttttaatgaaacaggtgcgtgcctcgctaagatcttgtgaagaatcagggtttgtttatcaattagctgaggcagaacaaagcaggcagatatttgagactatattatcgaattctttcccaagtgcagtgcgtgaagttgatataagcgacaaggagacagccatatcgcttattttagaaaacattgcggatacgggggttgaacggatgaatgatattgtttatctgtttcatccgtatagtaatgaagtcggtgctatcaaatgtgcgctgaaggattgtgcaagtcatctgcactgtctcatggattttatagattttgaaggccggctgctttctaacagctttattttagtggagccgtccttctcattttctgtctgtttatttcacacagaatacggctgtgagcttgtgtgtaaaccgccgaaaagaggtacaagatgcatcccttttttataaagaacacaaaggaatcggcagtctttcaatttcgaatatattccttatttcatgaagacaaagcgttgcccgaacaagtttttaaacaacgaaaacattattatctattcgaagaattccactgggtcttgtctgaagaaggctgggaaatgctcaaaagtttggcgcatcatcatcacgatgaatttatcttaatggctgttctgacacaaccggatgatatgaatcggttttacgaggaattcggatattttaactggttaaagattcctttaaatataaccgaagatgaatatctttcaatcttaactgattatccaaagcacagtaaaaatgacagcataatgaatattgcatcccgcgtcgtatgggcttcaccgactttaaagtgggcgatttacggagagagagattttgaaatctgtattctaggtattgatcaggagattgcgggaaaaacgttaggatcatggaggcccttagacgaccgtgttttagactgggtatctgttgtattcccggatcagattgtttcggatgaatttcaaaaaaagctcgcggcgcattataagtacaaggggaaatgacatgaaaataaaaatgaataagatagtcgaagaatcagtaaaaggatgtttttgtcattttgataactgcgggcatctgtatctcggacggcatcagaatgacgggctttcgtttacgatcatcgacaaatcgggcgatacgcgagtgattcatatcgatgaacaaatcccgtatgaggatattatgctgtttcaacagagttcggctgactggtatgtgttgattttctttgaatcgcatgagtataaagtgaaagtattttcagcagaaggaacagaacaaagtgcattttctctgccttcaggggtttcatgcagtcttttggatgaaaaacaaaacctgtggatcggtttaagtgatgaaggtatttatagtgatgaaaatcctgaagggcacagtgtgctgtgcttcactttagacgggcagctaaagaaaactcacattgatcagcagctttcagaaatatatgcgcccgcggcagatgactgctatgcacttgcagaaaaagacggactgatctacatgctgtattactcttatacagtcattgctgcgtttgatgaaaccgacgtgaaacgagtttggattatttctgataaaacatattccggggtttacgaccagctagcgatttctgatgacgggttttgggtatgcaaagatgatcattcactgtctctcattccggccgatgtcagtctgccgatgcaagaggtaatgtgctgtgatgcggatggtcatgagctttccgggcatcagctaaagctgactggcaatgccatttacgcggtctcgaattcggggatttataagcgggatatcagtaattggaaagtgtcaaaatgagatgatgaaatccaacagatattctttaaatgatgacgtcatccaaaacctgaaattacacaaaaaagaattagagggtccgctgccttcagatgctgggagatttgaagaagactttgagggggctgactgcgcgggggatttttatgagtatttcgcgcttatctgcggcagcttagattttgtgttggcagataaacaaatgcctgcgcggcagcgtaaagctttatataaatccttttttgagctgtatcctcaatatgcgcagctgaaaaatgctttaacggattatccggagctcagccgggaaatcgggcggcatgaacgggtgagagggctgttggtcagcattttaaacaagaaaggcaggcttctgacgtgaaagaaccaacaatagcagaatgtctgaagaaggctgatctgatcctgaacggtcaagcggtaagggaagaagtgtcggattgggcgtgggggtacgtgactgcacatgatccggaggttgaggatgaaaacgtttgggagatgctcgtgtatttgagcggtttgatctgaaagattcgcctgattcgtatctgcatacgattgaagaattaaaagattggatgcagggatataggtaaccgggaatacatgaagaaagggtgcgttcatgtcggaattagtctttacaagaatcaatacaaaaataaacacaagcggcccaatcattctgtccatgaatgcagcggaactcatcgtactggctcaggaaaaagtgcggaaagaagaatatatcaatcacattttcatattccggaacggtgatggacatttacgtcatcgctatcaaattcaaacatcaatgaatataatcggagttcaaaaatcgggggatttatttttgtttcttattcataaggactatgaagatggggtgattcaggaagatccgaatatttatatatggcacccgctcaaagggttttatcattcgctctacgggggacgttatatccggtcaatgacagtcgattctgcgaataatttgtggctgggctacgatgaagcgggaatattttcttgcctggacgacgatatcagttcaaaaggcgtggcccgctttccctttgaagacggaacttggaaatcttgcagtgatactttccgtacggctccgcaccttattgatcatttttacggggcgtatgcaaaaaaagatgccatgtatcttcattatcgtacgcttggtgaagattatattcggaaggtcgatttgcaaggcgaaacgttaagctttcatagggcggactttgactttagtgcacaattcaagaaagattcatcatattattttttgattcggaatcaagcttcgtgccaaattgacaaagcgctaaaatttcataacatgacaaaacaggctggggaatatcagctcactgataaaatctcaagaaaacctctccgttttacgcaagtggctgcttatcaagataaggctgcggggattgatgagagcaacaggctttacttgctgagctgacaggcggcttttaaaaaaggaagggcagaggtgaaacgtttgaaactgcgggaggcagaatacatgaattggcatggtttgagtgaggaggagacagagcagttgtggcgcagggtgaatcgcgcagtgaaatggaaaccgtacagtacatttgcttcaataaaacctccgaagccgtttcaagtctttaatgtatctcaaggattcaatggtatcggttttctggaagatgcagagatgcagattctaaaggcatttcaatcttgtacgttaaagcatgagtttatgtatgcgctggactggcagcatgaatgttatctatttaatcctcatgtgccaattgataaagatgaattcggtgaatggcttgtccccgttattccaaacggagactatggtttctttattcaccaggagtttcagtgggggctgttgggggatccgcggcagcaaaccattacgatatttggctcaccgctaataagggcgatagaaagaaacgctcctgtcttatttcaaaagtgaagacagcttgtgaatgaatctcatgcttttacgggaggaggaataacaggatgacagaagaagagttcggagctgcggaacaaagcttgagagcgtcttttccgaaagcgtataaacggctgcttcataaaaagaaccctgcggaaatcggaggatggattttttttcctatccgtgaacaaagccgcttacagaaaacttgggatgatgtgatcaggcaaaacagtgtgtgcagagaagagagcatgcccgacgatatgatcgtaattgctgacaacggaaccggagataagctgtgcttgaaaaagaaggacggtgtaatggaggagactgtttatttgtgggatcatgagactgccgatgttgagttgtatgccgcttctataggagaatttatagaaaatgaaaaagaataagtggctgattcaagagcttttagaattccgccttttccgggaacgagagatttctgtaattgagttggtgttttccttcgagtatgaacatcagctcatttgtttgaggctcatatgcaaagacgtttcttccgttcaaataaaagaaatggagagtcatgctgctggttcaggcattgtaacaattgatcctgctgctgacggagatgagggacagcattttctcgtggaggagtgggagaaccaaacgttccgcttttattgccgtcaatatgaaacagctgaaaagaaggaggcacaaaatggagtggcacaaacatgagaaagcagttctgctggggccggattcgccgggttgttttgaattgacggagtttatgttctataacgggtataacgagtattatgataaaatcccggtttttgaggtgaagctggctgatggacagtatgatgctgtgctgcggtttgaaggtgtgagtgctgcccggctggatgatctggagagcatcaccgacatccatctggatatcagcccggtcgacggcggctgggaatcgatacgctattatgtcgatgacggggaaggaagaatgagcttctattgcgccaagtgggtcgtgcttgacatgaagaaaaagcagtcccccgaatggcccggcaaaacgtcagggtaaagcggcggcatttcgcgtataatgaggggagccggacagagaaggagtttagtcatgaatgagtttaatgaatatgcgatcagccccgaaatccgacgggcgctgaatggcttgcaatacaccgagccgactgaagtgcagcggcgcgtcatccccgccgcgctgcaaaaaaaagacctcgtcgtcaaatcgcagacgggcagcggcaaaaccgcggctttcggcattccgatctgcgagcttgcggaatgggaggaaaacaaaccgcaggcgctgattttaacgccgacccgcgagcttgcggcgcagattaaagaagatatcacgaatatcggccgtttcaaacggataaaagccacggcggttttcggaaaagcttcttttgacaaacagaaaaccgaattgaagcaaaaaagccacgtcgttgccggaacgccggggcgtgtgcttgatcatatagaaaaagggacgctgccgcttgaacggctggcgtatgtggtgattgacgaagcggatgaaatgctgaatatgggatttattgaacaggtggaagccatcattcagcatctgccgaaaaacagagtcaccatgctgttttcagcgacgctgccggatgacgtcgagaagctgagccgcacatatatgaaagaccctgaattgattgaagtaaaagcggaaggcctgacgacaaaagacattgagcattttgtcaccagaacagaagaagaggacaaaacatctttgctgcgtgatgtcctgatcaccgaaaacccggacagctgcattatattctgccggacaaaagaaagagtcatccagttaaccgatgagctggacaggctgggctatccttgcgataaaattcacggcggcatggtgcaggaagaccgctttgacgttatgaacgagttcaagcgcggcgagttccgctatctcgttgcgaccgatgttgccgccagaggaattgatatcgaaaacatcagcctcgtcatcaattatgatattccgcttgaaaaagaaagctatgtgcaccgcaccggccgaacggggcgcgccggacaccgcggccgggccatcacgtttgtgacgccgtttgaagcgcggtttctgaatgacattgagacatatatcggtttccgcatccaaaagcgggaagcaccgtcagaaaaagaaacagcggaacggaaagcagcttttgcggaaaaactgaacgcccgcccagacgtcaaaacagacaaaagcgaacagttaagcaaagacatcatgaaactgtactttaacggcgggaaaaagaaaaaactcagagcggtcgattttgtcggaacgattgcgaaaatcgacggcgtttcagccgatgatatcgggattatcacgattctggacaacgcatcgtacgtcgaaattctgaacggcaaaggcccgcacgttcttgacatcatgaaaaatacgacggtcaaaggcaaaaaactgaaagtccataaagccaagaaataaaaaagaaagcctgccgcgcgcaggctttttttacgccgtctcctcggggacgaacgcaaggatggcaatgccgatcacaaataacaaaatcaggctgaacacggcggctgacgaattcccggtcagctgggcggtgacggcaatcaaaagcgggccgataatcgaagcgaacttgccgaagatattataaaatccgaaaaactcattggcgttctgtttggggacaagctttgcaaagtaagagcggctcagcgcctgaatacctccttgggaagtggcgacaagcatagccaaaatccagaagtcaaaagcggaatccataaaataagcatacgtgcagacaatcatatacacgccgattccggcataaagcatcgtttttcctttaaaccgttcggccagccgcccatacaaaatcgaaaaaggcgcggcgacgacctgagtgacaaataaaacaatcagcagatttgccgcgctgatgccgaggtcagccccgtatgacgtggacatcgtaatgatggtgccgaccccgtcgatgtagaagaaataggcgagcagaaacaaaaacagcgcccggtgcttcctgatctgcctcagcgtgccggccagccgtttaaaactgctgattacaagccgcggctccctctcgatataatagcgctggcggacgcggagaaggagcgggatcgaaaacagcccccaccatgccgccgtaatcaaaaaggcaatgcggccggcagcctgggcggacagcggaatcacctccgcttgtgctgaaagaatcacggcaatgctgaggagaaaagggatcgtactgccgatatagcccagcccaaaccctctggcggacaccatattcatccgctcctttgcggccacatcaacgagaaacgcatcataaaacacattagacccggcaaagccgatcgtggaaatcgtataacaaattaataacagcatccaagattcgccgggaatcaaagccagcgcggctgtgcccgccacaccgatcagaagaaagaaggcaaaaaaccgtttcttgcatcctttgtagtcggcaatcgttcctaagacgggaccgagcatcgccaaaataaaagtcgcggcggcaatcgtatagcccaaataagcggtagaatccgccgcgctgacaccgttttccgccgccgcggctttaaaaaacaaggggaataccgccgtcataataatgaccgaataagctgaattggcccaatcatacagcatccagctgctttcttctttcgaaaaccgtttcatcacacacgctccttcccaaaaaccggttctctgcattatatgcgccgctgcctcatcgttggacaatgatttctgaacggcgttttctgattgacctggagatattgacctagttcaaaaaggatgtaaaatcaaggtgtagcaggtaaatggtcaggcgggagggagacagaattgaagattgcgaaagtcattaataataatgttgtcagtgtgctcaaagaagacaatcaggaattggttatcatgggccggggcattgcttttcaaaagaaaacgggagacccggtagatgaagcccgcattgagaaagtgttcacgctcgataacaaagatgtatccgaaaagttcaaaacccttttgtatgatatcccgatcgaatgtatggaagtatccgaagagattatcagctatgcgaaattacagctcggcaaaaagctcaatgacagcatctatgtgtcgctgaccgaccatattaactttgcgatccagcgcaataagaaagggctggatatcaaaaacgccttactgtgggaaacgaaacggctgtacaaagacgaatttgcaatcggcaaacaagcgttggccatggtaaaaaacaagactggcgtgtctctgccggaggatgaagcaggctttattgcgctgcatattgtcaatgccgagctgaatgaagagatgcccaatatcatcaacattacaaaagtcatgcaagagattttgagtatcgtaaaataccattttaagattgacttcaacgaggaatcacttcactattatcggtttgtcacccacttaaagtttttcgcgcagcgtctttttaacggcacacatatggaaagccaggacgattttttgctggagacagtgaaagaaaagtaccatcgggcgtatgaatgcacgaagaaaatccaaacatgcattgagaggacgtatgaacacaagctcaccagtgacgagctgctgtatttaacgattcacatagaaagggtagtcaaataagcataatgaaagcgttggcatttttttcttcatttacgtatgatcttgttaggattgttactgataagcaggcaaaacctaaattacaatgagcactgatcatttctgtttgtgctgatggtaatttaggtttttttaagattcattattatcattattctgaccgatgtccccttttaacagaatcatgtatgatcaataaagaaatcgctttcaaagaaaggggaatgccgacatgttttatcgtatgaaacgagtgctgctgcttcttgtcactggattgtttttgagtttgtgtgcgatcacttctactgcatcagctcaaacaggcggatcgttttttgaaccttttaacagctataactccggattatggcaaaaagcaaatggttattccaatggagatatgttcaactgcacgtggcgtgcaaataatgtatcaatgacgtcatcaggtgaaatgcgtttggcgctgacaagcccgtcttataacaagtttgactgcggggagaaccgctccgttcaaacctatggctacggactttatgaagtcagaatgaaaccggctaaaaacacagggatcgtttcatcgttcttcacttatacaggtccaacggatggcactccttgggatgagattgatatcgaatttttaggaaaagacacgacaaaggttcaatttaactattatacaaatggcgcgggaaaccatgagaaggttggggatctcggatttgacgcggccaatgcctatcatacgtatgcgttcgattggcagccaaactctattaaatggtatgtcgatgggcaattaaaacatactgcgacaagccaaatcccgacaaacccgggaaagatcatgatgaacttgtggaatgggataggtgtcgatgactggctcggttcctacaatggtgtaaatccgctatacgctcattatgactgggtgcgctatacaaaaaaataatgtacagaaaaggatttccgctggcggaaatccttttttaattaaaacgaaataatcccaatcaaaagcgccgcaatcgtcatcacaatcgttgtccccacggcccatttaatagtgaatttttgatgatcgccaaagctgacgcccgccattccgaccaatagataggtggatggcacaagcgggctgagcagatgcaccggctggcccagcaaggaggctcttccgatttcagcggcgtctattccgtaagcggaagcggcttcggcgatgatgggaagcacaccgaagtaaaaggcgtcatttgacatgaaaaaggtgaaaggcatgctggcaatcgcagtgatcaacggcagatgcgggcccatggcatcagggatgagggaaacgagagaatgcgccatcgcatccaccatttttgtgccggagagaatgcctgtgaatatgcctgccgcaaacaccattgagacaacgtttaacgcattacccgcatgcgctgaaatccgtttctgctgctctttgacatttggatagttgatcatcaaggcgatggcgaacgcgatcataaaaagaacagggattggcagcaggctggtgatcagcgcggccatcagagcgacagtcagcaacaggttgaaccactggagagcggggcgcttcagcggcgccgcctccggatcagaagacggcgcgtgttcaattgaaatgacaccgagccgcttccgttctttttttccgaggagataagcaacggcgatcacccagagaacgccggcaatcatagcaggaatcagcggtgtgaagacctccgacgtgtccaatttcaaggaagccaaaaccctcgccgtcggcccgccccacggaataatattcatgacgcccgaaccgagcatcgcgatccccgccagcaccaaacggttcatgccgagccgtttgtaaaggggcagcattgccgcaatcgtaatcatatacgttgttgtcccatctccgtccagcgaaatggtcatcgtcagaaccgctgtgccgacggcgatttttaacggatcccctttgacaagcgatagaattttggcaatgaggggatcaaacagacctgagtcaatcataatgccgaaatacaggatggcgaataacagcatgatcccggtaggagcgaggtctgtaacgccttgaatcatcatctcgccgagatctttgccaaatccgctgatcagggcaaacacaacaggaacgacaatcaaagcaataagagcggaaagccgattagacataataagatacataaagacaatcatcatcacaaaaccgagtatggcaagcacgatatgacctcccctgttcaatagctgtattggtaagcgctttcacaatttatttctgtgaaaatggcttatttcaaaatgtgtatgaccgcatatgtaaatacagacctaaaatcctaatgagccgatcagcagtttatatgaagaacgccgcgggtaaatgtgctgtagaatgtttcgttttaaaagggggaactgacatgagtgatgatcaaaacaaacgagtaaatgaacactcaaaggacgaacagctggagcagtaccggtctgataacagcggcaaaaaaatgacgaccaatcaggggcttcgcgtgtctgaggatgaacattctttaaaagcgggcgtccgcggccccacgctgatggaggattttcattttcgtgaaaaaatgacgcactttgaccacgagcggattccggaacgggtcgttcatgcgcgcgggtacggcgttcatgggcattttcaggtgtacgaaccgatgacggaatatacacgggcgaaatttttgcaggacccgtccgtcaaaacgcctgttttcgtccgtttctcaacagtggcgggctccaaggggtcagccgacaccgtccgtgacgccaggggatttgcgacgaagttttatactgaagaagggaactatgacctcgtcggaaacaatattccggtgttcttcattcaggacgcgatcaaattcccggatctcgttcacgccataaaaccggaaccgcacaatgaaatgccgcaggctgcgacggctcatgatacgttctgggattttgtcgctaataaccctgagtcggctcacatggtcatgtggacgatgtctgaccgcggcatcccgcggagctatcggatgatggagggcttcggcgtgcatacgttccgtttcgtcaacgagaaaggaaaagcgcgctttgtaaaattccactggaaacccgtgctcggcgttcattccctcgtatgggatgaagcgcagaaaattgccgggaaagatcccgatttcaaccgccgcgacctgtgggaaacgattgaaaacggcggcaaagtcgagtatgagctcggtgttcagatgattgacgaagaagatgaatttaaatttgatttcgatatccttgatccgacgaagctgtggccggaggagttggttcccgtcaagctgatcggaaaaatgacccttgaccgcaatcaggacaatgtctttgcggaaactgaacaagtcgcattccacccgggcaatgtcgtgccgggcatcgattttaccaatgacccgcttcttcaaggccggcttttctcttatacggatacacagctcatccgtcttggcgggccgaattttcacgagattccgatcaaccggccggtctgcccgttccataacaaccaatacgacggctaccaccggatgacgattaataagggccccgtcgcctatcataaaaattccctgcagaacaatgatccgtcgccggcctcagaagaagaaggcggatacgttcattacgaggaaaaagtagaaggcagaaaaatccgccagcgcagtgagagcttcaatgactatttttctcaggccaagatgttctggaacagcatgtctcccgccgagaaagaacatatcatctccgcgttctgttttgaagtcggaaaagtgaacagcaaggacgtgcagcagcaggtggttgatgtcttcagtcacgtcgacgccgggcttgccgagcgtgttgcgaaaggaatcggcgtgaacccgccgccgaaggaccgtgaatctgatgaaacgttcacttccccggccttaagccaggaaaacacggtgaagacggcagcgacaaggcaggtcgcggttttaaccgaccacgggttttctgatgagaaagtcaaacaagtgcttgacgcatgcaaacaggcgggagtcagagccgatatcatcagccccgcgctgggaaccgtcaagggagaaaacggtacggagctgaaagcgtcagccactttcctgacagcggattccgtcctgtacgacgctgttttcattccgggcggaaaacaaagcacagacagcctcaaagcccaaaaatcggccagagacttcgtcagcgaagctttcagccattacaaagcgatcggcgcctccggtgaaggaaaagaacttctcgccctcgccgccggaaccgaaagcggccccggccttgttccggacgggaaccatgaacaatttctgaaggccgtggctgagcatcggcattgggacagaaacatataagaatgaaaaagcgccttttatgagaggggcgcttttttcttgtgaaagtgaaatatctgaacgaagcattaatattgggagaaaacgaaaatggcttccgtgcaaatccgtccgggacattcagacaacagttctagagagtcagggcattgcattatttaagggttctgactgatggtgaaatgatctttggtttacttccgctctgtgtttgtgtatcttaggggtagattttctggaggagcgaatgatagtgaagccgtttaccgaaaaacaactcgaagaatattaccggcgtgacgaaaacatgatgattttggtgtttgcccagtggtgcgtcaatcatgaccttgatccgatggccatttacagcaaggcttatcccggacagcctttaaacgaagagctgcgaaaaacggctgaagagcttgtcgtgccgaaggaggaatcagaaccgattcctgatcaaaccgttatcggcgttttggagatgttcggcaactccgatttggcggaagccgtttatgaagccattgcgcaaagaccttcacggtaaaagaggcgtggattttccatgtctctttttttcatggagaaaatgtgaaagaaggcccagaaacaatttactgatctgcgctgtctatagagtgtaacccgttttcaaaaagggaacggtaatgaaaaggaggagttgtgatgaaaaaggcattcaaaatgatggcggccgtgctcttaaccgtgctgacagccgcgccgttcggaggtttcgcgccttcagccgaggccgcgcaaaccgcaaagcctgttgtcaaaagccatacgtataagcatgtaaagcagctgacataccccgaggtcacaaatacgggaaacgcatcttttgaaaagaaagtcaatcaggacttcaagcgctatattgaacaatcgtacaaagaatatgtgaaaaacaaaaaagacggtgaaaaacaaggctacaaagcggaataccaaacagattttaaggtgaagtataatcaagacggcaagctcagcattgagacggaagactacagttacacaggcggcgcacacgggctgacatccgttcagacctttaattacgacctggccgcgaaaaaacgggtcacactcgataatgtgctgaatacaaaaacgaaagctaacaaaacgagagactatctttacggctacatcaaaaaacatgacgatctgttcgaccgggacgtcaaaaaacaagatattactttgaataatgaaagacctttcttctttacgaaaaacggcattgccgttgtgttcggacaatatgatctcgggccttacgcggcaggaatccgggacgttttcgtacctgcatccgtctatcaataaaaaaaagcgatatcactccaaaacggagcggtatcgctttttttcttttaccagacaaacaatccgacaatcgccgcgctcaataaggaaacggcaattccgctgacaagcagcttccagacgttttttccgatgatggctgatttttcaccatcaagcagagattgataagatccgtagatcataccgatggtgctgaagtttgcgaatgatgtcaggaatgtcgtagccacggcaatcgtgtgcggcggaagtgaattcagctgccctttcagatcggccattgccacaaattcattcgtcgcgagcttgatgcccatcagctgtgcgacatacatcgcgtcatgtacgcctaatccgaggaggaaggcaaacggactgaagatgtatgagaaaatcttttgaatggtcaacccgtgcatgaacagcccgagtacgccgtttaacgcggccgttaacgccacatagccgatcaccatcgctaaaatgacaatgaccatgttcatgccgacaagcatactgttagaaatcgtggagaagaagtcttttttctccgcttttgaaggcacgtaaataatatcatcctctttagaaacgtccacgggattcagcatattggcgattaaaagcgcgtttaagcaattcagcgggatggctgtaaacacataagtggacggaaccatcgtcaagtatgatccgatgatcgagccgctgatgctgctcatgctcatcagcccgaatgtcagaagccgattgttgctgacggcggcaagctgctggcggatgacggctaaagcttccgtatttcctaaaaacatcatctggatggagaaaaagctctccagcttcggcagacgggatattttagaaatcagccagccgattttatcaatgagccacggcagaataccgaaatacgacagcatatcaaagaaggtcacgacgaagataatcggcagcaatgcgctgaagaaaaaatcaaccgtcggattggccatgacagacggaaaagcgaacgcaatcccttgactggcgcaggaaatcagccatgtaaagaacgcgccgatcttcccgatgacaaagccgccgacttttgtccctaacataaaccaagtaatcagaaactcaaagacgaggagcatgacaatcggacgccatttaatcttcttcttgttgggagagcataagaaaacaacagccatgacaacaatgagaccgacaatgttcaataaaaagtacatgtgagcaactcctataagggtattatggaaataaaaaaagctcttattcgtcacaaattcctgaaagccagaaagtgtgataaataagagccaaaagaaaagaatagactgacagcatcatatgcttttcactcgttcaaatttatgcaaactttcttgtagtctagtcttttacggcactaggtagaaacaatcagaccatattactgatcatatacaagaataacgatattacatgagatagcagtattttatcgtttcaatttttgaaaatcaacctttttagatattttcaaaataataaatttatattataaataaagaaaataaaggatgtgcataagtaattggataataaaggtataaaatacccccaaaaccgttccggttcattgtaaagacgggatgcagctgataaaatggatctgagggcacagccttcaaaagacggcagaaaaggggtcattttcgtgatcatccagttcattcgttacagataatgagaggtatagatgaataggttaaaccttccaattcggcgaggtttatttgtctatgcctttttcatttcatcggaatgacgaatgaatgaggtgtttttttgacgtctataaaaagaaaacgcgcggaattactgcaatcatgccagtccgtgttcaggtgtccgctatgccggtcggccatggcggtctcacaatacaaaagcttgatttgcggacaggggcatacatttgatatatcaaaacaaggatatgtgaatttcctcaataaatcggtcaaaacccgctatgacaggcagctgttcgaagcgagacgcgagctttttgacagccgggaattttttgggccggttcaaaaggagatcgccgccatcatcacccatattcaatctccgcaaacatcagcggcggtattggatgcgggatgcggagaagggtcacatttagccgccgtatgcaaatggcttcagcctgctttttccgtgacgggaatcggcattgatctctcgaaagaaggtgtgctgcatgccgcaaaggccttcgggaatcatatggtttttgccgtcgctgatgtggcggatgcgccgtttgccgacagctgttttgatgtcgtgatgtctgttttatcgccttggaattacaaggaatgcagcagacttttacgaaagggcggcacagtcattaaagcggtgccgcggcgtgattatttgaaggaagtaagggaattcttcttcggagacagccctcggcggaatgacaccgccgattctgcggccggacgattccaagcgggctttcaaacctttgagcgcaaacggctgtgttacacaaagactttagcgcagcctgacctcgagcggcttgtgaaaatgacgcccttaacatggaaatgtactgatgacagcatccggcggtttatcagccggaaagaggctgctgtcacgatagatatcgatattttaatcggaaccgatccgctgtaaaacggaaaagacacgctaatcgcgtgtctttttttttatttccagacttcaccggcaatgttgacgacatggcgcagtttcgcccattgctgttcttctgtgatcaggtttccttcctcagtggaggcgaatccgcattgcgggctgaggcaaagctgatccagactgacatattgtgaagcctcttcaatgcggcgtttaatcgcgtccttgtcttcaagttcgccatgtttcgacgtaatcaagccaagcacaagctgaagatcagagcgtttgacataacggagcggttcaaagccgccggagcgggaatcatcatattccagaaacaatccgtcaagatcaagcccgtcaaaaatcgtttcagccgctgcatcatagccgccttcagccgtccatgtggattggaagttgccgcggcagatatgcatcgtaaccttcagatcgtcagggcgatccttgatggcgtcattaatggaagcggcaaacagcttgcgcagctcatccggcgtcgtgccgaaagcttcaatctgacgaagccccgcttctgataagaaaacggcccatgcggtgtcatcgagctgaaggtagcggcacccggcgtcatagaaagcttgaatcgcttttttatacgcttttgacacatcgtgctgaaattgtttgtaatcattctggtaggacgctttttccaattttccgcggaaaaacagcatattcggacttgggatggtcattttcggaacagcatcgccggcaatgctgtgcaggaatttataatcttcgagcatcggatgctgagaaaaatcaatatctcccgttactttaatgccgcgcgctttcgtctgtacgttgtgaaactgaatgccgctttcaggcgtaaacgcttcgacgccgtctaaattttcgagaaaatcaaaatgccaccaggcacggcggaattcgccgtcagtcacgacattgaggccggtttctttctgcttttctacgctgcggatgatttctctgttttcgatttcgcgcagctgttctgccgaaatctcacccgccgctctttgcaggcgggcttgcttcacagccgccggccgcagcaggcttccgacctgatccgcgcgaaacggcgggttttttcttagaagcgtatgcaatggttgttctgtgttttgctgtgacatgaacgattccttctttcctgatgaaatataaaaaaactcttccctcggatagggaagagcttgcgtccgcaaatctcaaccttatcttcaggatttagcaccattctgctgaacagcggttgccgggtatcatagggccagtccctccacctctcttgataaggaaatatgctatttttcagaataaactgtaatactcttaatcttagtatattatcttatattgtcaatatatttcgataaatatttttatttgtcaccctcaaatagaatcatatctatcacgatggcgatcgcgagacaaagaacgatatcctcttccttttcaatctgcaaatgataggaatcgccccagctcatccatgatttggtgacggtcatccggtttgattttccgtctgtcacttgaaaattccggccccacacatcgccggtaagatcccagccgagtccggaaatttcaaatttcggtttgaaaaacgtgactttcttgatgacttggcagacgggtttgccgctgacggaaatctcgtaacggggaacgagcgacatcagtttctggttgacgctggcgagcgtgcggccgtccaaatcagtcagtttcagttcatcaccgaatgaaaacagctttccttcaacattgtagacttcttttccgctttcaagaaacacttgaaaacgattcttaaacgtaaacattcgctctttgatgtaaaaatggtacataaaaaaactcctttcttatgttgtacgaaaaaaggaggcggttggtttcatatcggccgggtgcataaaaaaaaggctgccgattttgcggcagctgtcgtttttatgatatcggcatccggcgtttttgacggatcgcatttaaatcaatgatgttattcgtgtcggcagctgtcaccagcgggcttgtctttggcgttttccggcggttgtccttactgaaagagaaaacaagataccctgtcaaagcagcaaaaataagtagcatcattttacatacctcccaaaaaaagttttggtattattattgtacgaaaaaacaaacgaaaagtattcaaacaattgtcacttttttaaaaaataacgtcattttccgtaaaaatgactatgggttgaagagattttgctcttgttgtggttctatagattgtatcggctgatgaatgatgatcgtttatataactttttcactattttttgtaagtgtctaattaactacttcagtgttttcgtttgccttgtgttattcagtaccctaaaaaaccttatcatatgcaaaataactgcttctaacagatgactgcgggatgacagcgctttctttatttttttaaagaaaacgagatgttatcttaaaaaaatcgtttgaacattttccgcagttttttaaaagggtttgatttcgtctccagaatacgcgggtcttttaaggtttttttcaattctttcgctacagtccctcttgccatagtcttcactccttctttccaattcataccttatatacggaaagaaagaaggaaaggtttcatgtgaaagaaaaaaaccaaagcagggggctttggttttaagcgcgctcttcaaagagcctggcgatttcaacaatgacgtttaccgccttttccatatgatcgacggaaatgtattcatattttccgtggaagttttggccgcccgtaaaaatgttcggtgtcggcagccccatgtaagagagctgtgatccgtcggttccgccccggatcggttcgataatcggttcgatatcgaggtttttcatggcttgataggcgacatcgactatctctttgaccggttcgattttttctctcatgttgtaatattgatcacgcagttcaagcttgatgctttccttgccgtatttggccgccagcgcatcggcggttttctgcatatattcttttcgttctgcaaagcggtctctgtcaaagtctctgatgatgtacgacagggcggcttcagaaacgtctccgttcatggaaagtaaatgatagaagccttcatacccttccgtatattccggcgcttcttctttcggcagcgcgtgatgaaattccatcgcgatttttgaagcgttgaccattttgtttttcgccgttcccgggtggacgctttttccgtaacaagtaagctttgcggcggctgcgttaaagctttcatattgcagttcgccgagggggcctccgtctatcgtgtaggcgaatgcggcgttgaagcggccgacatcgaatttgtgagggcctctgccgatttcttcatcgggcgtaaacgcgacccggatcgttccgtgtttgatgtccggatgtttgatcaagtacgccattgccgtcatgatttcggcaatgcccgctttgttgtcggctccgagcagcgtcgtgccgtctgttgtgatcagcgtctggcctttatagcgggagagctccgggaattgctcaggcgacaggacgacattgagtttgtcattcagaacgatatcatgtccgtcgtagctctcaataatctgaggattcacatttttcccggtaaaatcggtcgcggtgtccacgtgagccagaaaaccgacagtcggcacgtctttatccgtatttgccggcagagtcgccatgacgtacccattgtcatcgactgtgatgtctgtcatgccgatcgactttaattcatctgccagcatgttggccaatgtcagctggccgggggttgaagggcagttttcattgttttcgtcagactgtgtatcgacttttacataagaggtaaagcgttcaatgatttcatttttcataccgtcatctcctttgtcttatcttaccatgcgcgggggagggatttctatttcacaacccgtttgaatcgagggctctgtgtattacgcgaatgaaaacaaattatgaagaaacgatgactaaacgattaaactttttggaaatggatgattgaggaagaaaaaaccgatataatatggtcaattcattcaataggggaggctttcttcatggcgattttagtgacaggcggagcgggttatatcggaagccacacatgtgtcgagctgttaaacggcggctatgacatcgtggttttggataatctgtcaaatagttcaccggaagcattggagcgtgtgaaagacattaccggaaaagggcttgtattttatgaagcggatctccttgaccgtgacgccgttcaccgggtgtttgctgaaaatgagattgaagccgtcattcattttgcgggattaaaagccgtcggtgagtctgtagctgttccgctccgttattatcataataatctgacggggacgtttattttatgtgaagccatgcaggcacacggtgtgaaaaaaatcgtcttcagttcttcagcgacggtttacggcgttccggaaacaacgccgatcactgaggattttcctttaagcgccaccaatccttacgggcagacaaagctgatgctggaacagattttacgcgatctgcataaagcggattctgaatggagcattgcgctgctccgctactttaatccgttcggcgcgcacccgagcgggcggatcggagaagacccgaacggcatcccgaataatttaatgccgtacgtcgcacaagtcgctgtcggcaagcttgagcaattgcaggtgttcggcaatgattatccgacaaaggacggcaccggcgtgcgggattacatccatgtcgttgaccttgccgagggccacgtcagagcgcttgaaaaggtgctgaacacaacaggcgcggatgcctataatctcggcacgggaagaggctacagcgttcttgagatggtcaaggcgtttgaaaaagtatcgggaaaagaagtgccgtaccgttttgccgcccggcgcccgggagacatcgccgcatgcttcgcagacccggcaaaagcgaagactgaattaggctgggaagcaaagcgcgggcttgaagaaatgtgcgccgactcttggaagtggcagtcctccaatgtgaacgggtaccaaaaggtgtaaaaagaaagagaccttcaaatggtgaaggtctcttttattacggtcattatttaattttcacttcaacatcgttgctgaactttaatttccaagtgcctttagagtatgcgtttttatcaacttcaaaagcttttacgtcagtaactttaatgttcgggttcaagtcacttaaaattttactgttgtctacttttgtttctgttgcatagcttgaagaagcatcaatatctgaatcataggatgttcctttagaatctactaatttcgctcttggaatggagaaagagcttaacggcttgtttgaaacatttttaactgtgtattgaacagctacgataacgccgccgtcagacgcttttttctcgacaaattgagagcctactgaatctcttttttcgactttcgtaacagtaacttcagttttctcagtcttaacagtgtcaccgatgttatacagtttttccttggattccgcagcttttgaagacgcggttttagatgatgaagatccgcctccgccgccgatgttcacgagaatgataataaccactactgccagaagcaatgtgataattttatgtctcataaaaaagtttctctgatctttaccgcagtttgggcattttttaacgcctttagcgatttctttgccgcatgccttacaagacaccaggttgcctgccataatatttcctcctatgtaaactatttcttgaaaactacatactataatgcctgtaaaataacctatagtcaataatattttgagaaaaaaagtattttaatgattttttagtcatgtattttaaggaccttttttagtatcggcagatcgttcgaattttttatacgtttattgaaaaaagagtggttgaacatgttcgtgatttcccgtataatcttgaaagatatacaaaaactgaacataaaaaacagtggttttctagggttccgcaatgctgaattggtctggaccgagagaaaacacacagcaggttcctgctgtgacacgttgggataaaagcccgggagtttctgctcttttaatgaagagtgctctcccgggcttttttgattttatataaagggagtgtctgggatgaaaaagagattgctggatgtgctgatgctgattattggggcttttatctttgctttggccgttaatttattcgccattccgaatgatcttggagagggcggggtaacgggaatcaccctgattttgtactatgtgtttgaatggtcgcccggggtgacgaatatcattttgaacgggatcttattgattatcggatataaatttttagacggaaaaacaacgctttatacgatcattaccgttgtcgccaactcactgtttctgcatctgacgcatgattggcactcgccttcacatgaactcattattaatactatttttgcgggtgtgtttgccggtgtcggaatcgggatcattattcgagtcggaggcacgactgcgggttctgccattttggcgaggattgcgaacaaatatctcgattggaatatcagctatgcgcttttgttctttgatctgattgtcgtcttcagttcttatttcatcatcggtgcagaaaaaatgatgtttaccattgtcatgctgtacatcggaacgaaggtgatggactttatcattgaaggcctgaatacgaaaaaagcggtgacgattatatctgagcataagcacgaaatcgccgaacaggtcaacacgcttatggacagaggggttacgctgctgtcgggtaaaggaaattacacggggcagtcgaaggaaattttatatatcgtcatccagaaacaagagctttccatgctcaaaaaaattattaaaagctgtgatacaaaagcgtttgtcattgttcatgatgtgcgtgacgtctttggtgaaggcttcgtcgatatctctaaataaaaaggatccctctgccggcgcggagggtttttttcttatgccggcagaagctgttatgatccgtttcccgggaaatagcctgaaagctgtttcttaaaacgaagtggatacaatcggccggacgttttatactgacaatatgatagagcgatagagaggagcgcatatgaacccgttattggcaatttacccgagggctgtgttgtctgatacgtgctgtacggcggaggatgtcttttgcttttatgatgagaaaaggcggatctatgtcgccattccgaaggaggatatcaccccgaaggagaaactgcttctggaatcacttttgacgcccgctgaagaaaaaggcgatttttttccggagacggcggcagcaaagaggtggcggcggtttctgctggaagaaggcccggtgcctgatgtcaaggagccgcgtgtccgttttatccattatgacttattgggagaacgggactggggggcatttacggaagcgctgcgccatttctggccggtttcatatacagttgtccggacgggaagggatcagggcgtgattgtggaggaagaaaagctggaagcgccagattcggatgacatcgcatcttttgtgaagattctcgaaggcgatttttatttcagtgtccgttttttcatcggaaggtattatggcgcgggagaacgtctgcgccttcattatcggagagaacagcaatattgtcagattggccggcgtcatctcccgcagctgagcacgctgaccgcggaaacggtatttccggctatgctcatggaagaaagcagagaaaagctctcagccttgcttcacgaagaagcggtgctgctgtttcagaaagaaccggagctgaagcatacgattcagacttttattgaacataactcgaacatgtcgctcacatcgaaaagactgcatttgcaccgtaacagtcttcaatatcggattgataaatttgcggaacgctcgggtattgatattaagacatatctgggcgccctgctggcttatttcatttgtctgcagtatgaaaaatcacattaaatgggaaatgtgcacgaaggcagcggactttttttatgaacattgcctatatccgccgccgtctgacgctgttacaatcctattaaagaaagcgtttacaaaaagggggagatgacatggcggaacttcggctggagcatatttataagtattacgatcaaaaagaagcggctgtcgatgattttaaccttcatattcaagataaagagtttatcgtgtttgtcggtccgtcggggtgcggcaagtcgacaacattgcggatggttgccgggctggaagacattacgaagggcgatttctatatcggtgacacgagagtgaatgatatcgctcctaaagacagggatatcgccatggtgtttcaaaactatgcgttatatccgcacatgacggtctatgataatatcgctttcggtctgaagctgaggaagatgccgaaacctgagataaaaaaacgggtcgaagaagcggcgaaaatgcttgggctcacagagtatctgtaccgcaaaccgaaggcgctctccggcgggcagcggcagcgggttgcattaggccgggcgattgtcagggacgccaaagtgttcttaatggatgagccgctgtcaaatctggacgcaaagcttcgggtgcagatgcgggcagaaattattaagctccaccaaaggctgcaaacaaccacaatctatgtgacgcacgaccaaacagaagcactgacgatggcgacacgcatcgtagtcatgaaggacggaaaaattcagcagatcggcacaccgaaagacgtgtatgaacatcccgaaaacgtatttgtcggcgggtttatcggctccccagcgatgaactttttcaaaggaaagctgacggacggcgccattcagatcggttcagccgctctcagcgtgccggatgggaaaatgaaaatgctccgggaaaaagggtatgccggcaaagatgttatcttcggcatccgcccggaagacatacatgatgagctgattgtggtagaatcctataagaagtcatccatcacagctaaaatcaatgtcgcggaattgctcgggtcagaaattatggtttattcccggatcggggatcaggattttatcgcccggattgacgcccgccatgacatacgtgccggtgaggaattgaccgtcgctttcgacatgaataaagctcacttttttgacagtgaaacagaaatcagaatccgctcataacgcaaagccggacagctggatgtccggcttttttgatgtaacaatttatgacgcataaccgatataaaaagtaaatagaagacagaaagcaggaaaacgatgaaacgcatgatcatgtgcatgtgccttttggctgccgtgtttacgcttgccgcctgctcgggccatgaggcaagcgccgaacaaagcattccgaaggcagaagcgcaccacgataaaaagtctgtaaagcgccaaatcaaaaaagagccggatacgtccgcctgggttcaaacgaaaggaacggcaagactgccgattctgatgtaccacagcatttctgagggaaacagcctgcgtgtgccgaaggaagaattccggcagcatatgaagtggcttcatgatcacggctattatacgatgactcctgaagaggcctatctgatgctgacggaggataaggagccgcgtgaaaaatgtgtgctgatcacatttgatgacggctataccgacaatgtgaaagcggcctatcccattttaaagaaatacaagatgaaagcgacaatctttatgatcggaaactatatcgggcataagaatcatctgactgagaagcagatgaaggagatggccgcccacggcatttccattcagagccatacgatgaaccatctcgaattgaacgggctcacaccgcagcagcagcgacgtgaaatgaaggactctaagcgtttatttgatcaaatgttcgggcagcggacgtctatgatcagctaccctgtcggacgatataataaggaaacattaaaagccgccgccgcgtcaggctaccgtatggcggttacgacggagccgggagcggcgtcaagagatcaggggctttacgggcttcaccgcgtccgtgtatcgccgggcatgtccggggcggcattcggctcttatattcaaaatgtgatgaaataacagagcctccgcatatgcggaggcttttttcagtttaatagaattgatgaagcagcagaagggtgacactcacggtaatcgctccgccgattctggtcgacacttgggcgaacggcataagctcaagccgttcagcggcgctcaagatcgcgacgtcgccggtgccgccctggccggaatggcaggcattaataatcgccgtctcaatcgggtacagattcagccattttccgatcagaaaaccgacggccatcatcgtgacgacgatagataaaatggtaatgatgttgctgatcgtaaacgccgcaatcagcttgtcccacggtgtcattgaaacgccgatcgcaaataagagcggataggtcacggctgtcgagaaaaagcgcgagacgccgaaggctccgttttcaatcgaagccggcgccagcctgaacagcttaatgagaacggcaaggacgagcatcacgacaggagccggaagctgaaagaaatcatgcgccagcatgccgactaaatagagggaaaccgctaaaataccgcccgaagcgaaaaaggacaaatcaaacgttttatcattggccggctgttccaatgcgggagcggaatgatcagacttatcaaccttcccgttgcccgtccattccggtttgcgtttcccgatgacattcagcaaacccgataacataatggcgcacaggctgccgagcatgatggacggcagcacaagcgcaaaggcgtctccctgggacatcggcataatatcggagtagccgatggataaaggaatcgcgccttcaccgacaccccccgccataatcggaacgacaatataaagcagtgtgtgctgaaagccgagcccgagaagcgtcccgacgcataagccgacgatggcggccgcgatcgagccggcgatcagcggaataaaaatcttgacgaaagctttgacgagcgtctctcttttcatcccaagaatactgccgacgacgataccggcaataaataaatagagaaagttggagctttctgtgaattctgttgttgaagtaataatgtctttcggaagcaggtggtagtagacgacagcggatggaataaaggttgcgagaatcgcagggccgccgatggaacgcacaatcggaatggattttccgatctggccgaaggtaaatccgaaaaaactcatgacggcaattgatgtcagaatgtcgcttttaacatcacggctcatgacaaacaccgtaataagcaagaaaagcaggatatagataggaagaggaataatgccgattcttatattcattgctctggcaaaccagttatcagtccgttcctgtttttggattgaatccgtttgcaattttggttgaagttctcccatgcttgttcccccagtcgttatgtagtgaaaaaatatccccatttaaagtatactaaaaaatttaaattgttcatatattatgaatttactagggggcatgctttcttcacattttctttctcaaaatggcgatttggcgggctttttcaccgagaaaagcattttgttcgccacacgaataaaaaagaggtacgatatcaaagggacaaatatcctaggtgctgacataaaatctctacaaatccgacaataatcggtcacaatttcagccttattttaggtatattgatctttttttttaggctgaatcgttgtaaagtaatgatattgaatcatttctatgacagccgctgtcccccagggtgtacaggctgatatttcaatagttttgacgaatttgtgaaacattgagcaaatatatcattttttgtgaaataccgagcaatgatttcgctatgtttgtgaaatgttgagcaatttaccagattggaggaaaaacatcatgagtgagttggtattagcccgcattcaatttgcatctacaacattgtttcacttcttgtttgtgcctttgtctatcgggcttgtgtttatggttgctttgatggagacgctttatgttgtcaaaaaacaagagacctatctcaaaatggctaaattttgggggcatctctttttaattaacttcgctgtcggcgtcgtcacagggattcttcaggaattccagttcggattgaactggtctgattattcccgttttgtcggagacgtatttggggctccgcttgcgattgaagcgcttttggcgttttttatggagtctatttttatcggattatggattttcggctgggaccgtttatctaaaaaagtgcatttgctttgcatttggcttgtatctttcggaacgattatgtcatctttctggattttgacggcaaactcattcatgcaggagccggtcggctttacgattaaaaacggccgagcggaaatgaatgatttcggggcgcttttgacaaaccctcagctttgggttgaattccctcacgtcattttcggggcgcttgcgacgggtgctttctttatcgccggtgtcagcgcatttaaattattgaagaaaaaagaagtgcctttcttccataaatctttcaagctttcgatgattgtcggtctgatcgccggtatcggcgttgcgttcagcggacatatgcaggctgagcatttaatggaatcgcagccgatgaaaatggctgccagtgaagcgctttgggatgacagcggtgatcctgccgcgtggacggcttttgcgaacattgatacgaataaagaaaaaaacacatcagaaatttcaattccttacgcactcagctacttggcttaccagaagttcagcggcagtgtgaaagggatgaaaacacttcaaaaagaatataaaaaaacgtacggaaaaggcgactatatcccgcctgtcaaaacgacgttctggagtttccgcattatggcgggagcgggcgcgcttatgatttttgccgcgattgccggctttattctgaaccgccgcaaaaagcttcatacgagcaagtggtatttacggggcatgatcgcgctgatcgcattcccgttcattgcgaactctgccggttggattatgactgaaatcggccgccagccgtggacggtcatggggcaaatgacgaccgcacaatccgtttcgcctaacgtaacgacgggatctctgctgttttcaattatcggcttcggcgtcatgtacttgattttaggcgcgctgcttgtcttcctattcgttcgtgaaattaaaaaaggtgcggaccatgatgatcacaaggatgttcctgtatcaacggatccgttcagtcaggaggtctaccatggggtcacttcatgatctttggtttgtactcgtttcagttttgtttgtcggatttttctttttagaaggttttgacttcggtgtcggcatttcgacccgatttcttggccataatgaattagaacgcagagtgctgattaacaccatcggcccgttctgggatgcgaatgaggtatggctgctgacaggtacgggagcgatcttcgcggcattcccgaactggtatgcgacgatgctgagcggatattatattccgtttatcatcatccttcttgctttaatgggacgcggcgtggcgtttgaattccgcggaaaagtgaatcatttaaaatgggtcaaaacatgggactgggtgattttcttcggcagccttatcccgccgtttgtattcggccttatcttcacaagcttgttccgcggcatgccgattgacggccatatgaatatgcatgcgggtttttcagatattgtgaacgtgtattccgtccttggcggagcagccgtcacccttctttcattcctgcacggtttaatgtttatcaccctgcgcacgatcggtgatttacaagagcgtgcgagaaaaatggcaaaacgcgtaatcggtgttatctttcttgttgtacttgctttctttgcgatgtctgcatacgatacggacatgtttacacgccgggcaaacatcacgattccggtattcgtgctgattgtcatctgcaacgttcttgctgttgtgttcatgagcaagaaaaaagacggctgggcattcggtatgaccggcgcgggtcttgctttgacagttgcgatgatttttatctctctgttcccgcgcgtcatggtcagctcgctgaaaagcgcgtatgacttaacagtagctaacgcgtcttccggtgattattcacttaaggtcatgacaattgccgcactgactctgctgccgtttgtcatcggcagtcagatctggagctattatgtcttccggaaacgcgtcagccataaggagcctatgacttattaatgggaaaagacctgtttctttataaaggaatgaagcggattcttgcgatcattacgggattaacgattatacaaacggctgccatcatcttgcaggcggaatggctgagccaggcggtaaccggattatttaacgggaagcggattgcttctctttatccggttatcggctttttcctgcttgcgtttttggtccggcatgcggtgacagcggtccggcagaaaatcgtgtaccaatatgccgcgcaaaccggcgcagacgtaagaaaaagatttcttgagcaattgttccgtctcggcccccgctttgcgaaaaaagaggggacaggccggatggtgacgctggcgatggaaggcatcagccagttccgccgttatttagagctgtttctgccgaaaatggtcagcatggcgattgtgccggcggccgttgtcatttacgtgttttttcaggataaaacatcggcattgattctgattcttgcgcttccgattttgattgtatttatgattctgctcggacttgtcgcacagaaaaaagctgatcgccaatggaagtcctatcagacgctttccaatcatttcgtggattcgctccgcggactggagacattgcggtttttaggattaagcaaatcacacagtgaaaacatctttcatgtcagtgagagataccgcaaggcgacgatgagcacgctccgggtcgcgtttttatcatcattcgccctggatttctttacgatgctgtcggtggcgacagtggcggtgtttctcggcttgcggctgatagacggacaaattctgctcgggccggcattgaccgcgctcattctcgcgcctgaatattttctcccggtccgcgaagtgggaaatgattaccacgcgacgttaaacgggcaggaggcggggaaaaccattcaagcgattttggcgcagcccggttttaaagaagaaaagccgctcgaacttgatacgtggactgacggggatgaattacagcttgcacgtttgtccgtccgagaatcgatgtctgaatttcatctgtccttcaaagggaagaagaaaatcgggattatcggggaaagcggtgcgggaaaatcgacactcattgatgtgctgggcggctttttagagcctgcgtccggtgagatcaaggtaaacggtgaatcccgctcgcatctgcagtcggacggctggcagaagcagctgctttatattccgcagcacccatacatttttgatgacacgcttttgaataatatccggttttatcatcctgatgcttcgcgtgaggacacggcgcaggccgctagatcggcgggtctttccgaactgatccgtgatctgcccggcggtcttgacggccggatcggcgagggcggacgggcgctcagcggagggcaggctcagcgtgtcgcgctggccagagcctttttaggaaaccggccgattctcctgttggatgagccgaccgctcaccttgatattgaaacagaatatgaaataaaagaaacgatgaaagacctgtttgaaaataagcttgtttttctggccactcaccgtcttcactggatgcttgagatggacgaaattatcgtgcttgatgacggcgcggtggcggaaatcggcacccacgacgaattgatggcgaaacaaggcgtatacgccaaacttgtaaaggcgcaactgggggaaagaacatgagaaaagaagaatggattctgccgtatatgaagcaaaatgcccgtttgtttgttcttgtgatttttttaggcgcggtgacgattttttcggcggcctttctcatgttcacttccggttttttgatctctaagtcggcggctaggcctgagaatatcctgctggtttacgttccgattgtagccgtgcggaccttcgggattgcccgttcagtctcacggtacgccgagcgtctgacggggcaccatatcattttgaaaatcgtgtccgacatgagggtgcggctttacaatatgctggagccggcctcgctcatgctttcatcccgttttcggacgggcgacatgctcggcattttggctgaggatattgagcatttgcaggatgcgtttttaaaaacgattttccctgcggtttccgctttgctgctgtatgcggcatccgttatcggactcggctttttttcctggccgtttgccgcttttgcggcgatttacctgtttatattggttgtattgtttccggttgtgtcgcttcttgtgacgagagcgaaaaacatgaggctgaaaagcggccggaatacgctctacagccggcttacagatgccgtgctcggcgtgagcgactggatgttctcgggacgccaggcggcctttatttcctcttatgaagagaaagagaaggcatggtttgatcttgaaagcaaacgtcagcggtttacgagatggcgtgatctcgccgcgcaatgccttgtcggcggcttcatattgatcatgctgttctggacggcgggtcagtatgcggacggcagcattgccaacacgatgatcgcggcctttgtgcttgtcgtatttccattgacggaggcgtttctgcccctttcggatgcgctgacggaagtgccttcttatcaggattccatcaatagaatgagtcaggcggctccggagctgcgaagtcgtgaggtgaagcagacagatgagaaactggatgtatctgatgtgacacttacatttgataacgtgacgttttcttatgatcagcactgtcatgtgcttgaccgtttttccttcactctccgccaaggtgaaaaaatggcgctgctcggcaggagcggctccggtaagtcgacctctctcgctttaattgaaggcgccttagttcccgattcgggcaaagtgatgctgaacgggctggaaactgcggccgtgcaggagcagatttcctcagcggtggccgttttgaatcagaaacctcatctctttaacacgagcattatgaacaatatccggctcggaaacggcaaggcgagtgatgaagatgttaagcgtgcggctcggcaagtgaagctgcatgattatattgaatcactgcctgacggatatgaaacgtccgtgcaggagacggggattcgtttctcaggcggggaacggcagcggatcgcgcttgcccgtattctgctccaagacacgccggtcattatccttgatgaaccgacggtcggccttgatgcggtcacggaacgcgaattgcttgatacgatttttgatgtctttaaagagaaaacgatcctctggattacacaccatttagcgggtgtggaaacagctgataaaatcgtctttttagaaaatggaaaagcagaaatggaaggaacccatcaagagcttcttgcagaaaacgaacggtaccggaagctttaccgtcttgatgttccggtcagaacataaacagccgcaaacgagcggctgtttttttgtgcggtttaaaatctcttcttgtttggaatataaataggagacagaagaggaggtacagagatgaatataatggattggacggaacaggatgtgaaagatacgctgccgaagcgggaggcagacagccataaggggacgttcgggacggcgttattgctggccggcagcgaagacatgccgggagccgcccttctggccggattgggcgcgatgagaagcggtgtcggcaagctcgtcatcggtacatcggcaggcgtcatcccgcttatcgtcccggtgctgccggaagcgacgtactggcgtgacggctggaaaaaagccgcggcgggccagcccggggaaaccatccgggccgctgccatcgggccgggccttcctcaaacagacgaagtgcagcaggcggctgatcagctgctttctgccgattatcccgtcatactggacgcgggcgccattacgaaaagaacctatccaaagaggaaagcccccgtgatcttgacgcctcatcccggcgaattttccagaatgacaggccttccgattcaagagattcagcagaacagagcgggatatgccgcagaatgggcggagcggcttcacgtcacgattgtcttgaaaggaaacgaaaccattatcgcttttcccgacggggaatgccgcaggaatacaaccggaaacggcgcgcttgcaaaaggcgggaccggcgacacgctgacgggaatgattctcggcatgctgtgctgtcatcaagacccgaagcatgccgtattgaacgccgtccgccttcacggtgaatgtgcggaggtatggacgaaagagcgctccgcccataccttattggcgcacgaactttctgaactgctgccgcgtgtatggaaggaatatgaataaagaaaaggcgtcttcatagagaaggcgcctcttgttgttttacccttgatttcatcaggacataatacagcagcgacggaacggccaggccgatgacccaggcaatgtcgcctccgccgaatatttcagcgagcggcccgatgtaaaaggatgtattgatgaacgggatttctaatataatcgacaaaacgaaggcggccgctgtaatccaattgaccctgccgtattgcccgttgacgtcaaacatcgatttgacgtggtattttccgcggcggataaaatagtaatccacgaggttgatcgccgtccatggaattaagaaataactgatgaaaaagatgaaatttaaaaacagttccatgaaattgctttggcccaagagacttaatacagtacctgctgccgtcacacaaagaatcattaccactctcgttttcggcgtcaccttcagttttaaaaacggctctaaggtagtcgtcgttgacataaaggctccgtataaattaaagacgttgatcgccatttgcccgaacaggacgatgatcagcataataaaggaaaacggaccgaacaatcggacaatctcatttcccgcattagcggtaaattccgggagcgccgtcgtcaaaatggcgccgagaagcatcatccagatggaactgactgacgtacctgcgtagctgtaccaaaaagtatgcgatgccggtgttttgaccggcagataacgggaataatctgcgacatatggcgcgtatgccagctgccatgtggccaccgcgctgaccgccactagaaaaacaggcagatctaatgagccgggcacccagcttcctgaaggaatcggcagttgaaaaataagaatcgttgcagcaaaaaaaacggcaaaggaggtccaagagaggattttctgcattttgtgaatcagatcatgaccgtagatcgtgagtaaaaaacagatggcgcttaagccgataatacaccatgaagccggaatcggtacaaagctgctcagtgtaccggctgcgagaatcgtactgctcgcaaagaagcccaggtagataaacatgaccaaaaagaggggcagaatcgccccgatcacgccgaattgcgcgcggctttgaatcatttgcggaattccgagctgaggtccttgtgcggaatgagacgccataaagattgcgccgataaaggtcccgataataatggcggcgatactccaaaagagatcgagtcccattgtaacgggcagtgtgcctgtgactaacgtcgtaatatgcatattcgccccgaaccagacggggaataaatctttagcctttccgtgtctttcgtcatgcggaatatgttcaatcgttcgcctttctactttcaatagataatctcctccgtatgttcttctttaacataaagacatagcttaacagattgacctgccgtttacaaattccagcatgcaggaaaaacattgtaaagcctcgctgacagccgtcaaagggttttttgaaaaacggaacaaacactgccgccaaaacgatttgccagggtttaaaaggcatggatatgcttacggactaatatgtattaaggagaaatgtgtcaatcttttgacgaatggagccattattcgttaagctgaaagaatagtttactttgtgtaaatttcattaatgaaaaggggattgatgatatgtgtacaagtcttacattgaaaacgacagacggtaatcacctattggcgcgaacgatggattttgcatttcagctcggtacggacgtcgtgctttaccctcgtcagtacagctggaaaagcgaagctgacggcaggatgcataagacgaaatacgcatttatcggcatggggagaaatctcggcaatgttctgtttgccgacggcgtaaatgaaaaagggctgtcgtgtgcgacgctgtattttccgggctttgcgggatacgagaaagcggaacgggagggcacctgtcacattgctcctcatgagtttgtcacctgggccttatcaaactgtgaatctcttgaagacataaaggaaaagctctcaatgctgacgattgtagagaagaagttaatgttattggatacggtgctgcctcttcattggattttatcagaccgcacgggcggctgcattgtcatcgagccgacaccggagggaatgaaagtatatgacaacaaacccggagtgatgaccaatagtccagaatttccttggcatgtgaccaatctgcgccattatatcggaatcaggccgcagcagtcagaaagcaaaacattgggcggaatgacattaaccgctttcggccaaggatctggaacgatcgggcttcccggtgattacacgccgccatcccgattcatcagagccgcttatctgaaagagcatttagagcctgctgctcatgaaacggatggcgttacggccgcttttcacgtgctgtccaatgtgaatattccaaaaggcgcggtgatcacagaggagaatgaaattgattatacgcagtatacgtcggtcatgtgctgtgacaccgggaactactactttcatctgtacgacaaccggcagattcacaaagtaagtttattccatgaagatcttgaccgtccggagccgaaagtatttgcggccgcggcggagcagaatatacaggagctgaattagctcaaaaaaaaacaggacgcgattgtcctgtttttttatttaatacggatcagacggatggctttcctgttcagcctgttttgcggcttgtgctgtatcagtagtgccgatcggcccgccgctgttgctttcggaggcttttttcagcccttccgccacacgttttccgtagtccggatctgcttttgtgaaattctcaatcatttgatcctgaatgtctttccggcaggaagaaagcgtattgaccaggtttgtgatcaattcgttccgttcaaattccgaaaatctgcggtatgtttctccggcctggccgaagttattcgaccggtcgatcgcttcccgcttcacatcgccttcgacatgaggtgtatggtctttcccatcctgctttgcttcgttgagtcctcccataacggacggctcatagttgacgtgcgggttttgtccttctgcccgatcgacccgatactgcatttgcccgccttcctggttggtggcgacatgctttttcggcgagttgatcggaagctgcaggtagtttgcgccgacgcggtaccgctgggtatctgaataggagaatgtccgcccctgaagtaatttgtcatccgaaaaatcaaggccgtccacaagcacgcccgttccgaatgacgcttgttccacctcggcatggtagttttccgggtttttgttcagaaccaatttaccgatcggcttccaagggaaatcgtctttataccacagcttggttggatcaagcggatcaaaatccagctcggggtgttcgtcatcagtcatgatttgcgcatacacttcccactcagggtaatcgcctttttcaatcgcttcatacaaatcctgtgtcgcatggttaaagtttttcccctgaatctcttccgcttccttctgtgtcaggttgcggatgccctgtttcggttcaaagtgatatttgacgagcactgcttttccttcttcattgacccatttgtaggcatggacgcctgagccctgcatctgccggtagttggccgggatgccccacggcgaaaacaagaatgtgatcatatgagtcgcttccggtgattgggaaatgaagtcgaaaatacgctcgccgtcctgaatgttcgtaacgggatcaggctgaaatgcgtgcacaagatccgggaacttcagcggatcacggataaaaaagattttcaagttgttgccgaccagatcccagttgccgtcttcggtataaagcttaacggcaaaaccccggggatcacgcaatgtttccggggaatgctttccgtggttgacggtagaaaaccgcacaaacgccggagttttcattcctttcttttgaaacactttcgctcttgtgtatgtagaaatctcctcgtctccaaaacttccgtacgcctcaaagtatccgtgtgcgccggcgccgcgcgcgtgaacgacgcgctcgggaatccgttcgcggtcaaagtggctgattttctccaaaaaatcataattctccaatgtcgtcggtcctctattgccgactgtcctgacattctggttgtcagtgaccggatggccctgccggtttgtcagcgtgtcttctgactcgcctttaccggtcgtcttactggaaagcgtttcttcgctgtttttgttattttccattgttgaaccctcctttttgaacggtaacaatatgcccagcagagccgtttcttaaaaccgattttcaaaagaagcagttattccgtgatcggcgtcaaggacccgccgttccatatttcgcccttgttcagcgtccagctgttttgataaagggcctgcgcgccttggttggccgccggacttaattgttcatcccatgtcaaaaagtacgtggtctcgggatacttttgcctgatcgcattgataaaagcagcataatcaaagcttccgatattgccggacggaccggtttcggcaaaggcaaacggttttttcagagacagcatttcatcatagcctgatatcgcatacggatcagtgaagtaagcgtccagaccggtaatatccacataagatgagcctgggtaaaagtctgtcttaaagtctctgttggcatccggcgaatacacccacaaaaggttatccaaccctcttgtctctgtcatatagcggtatatcttcttgtaaagctctttgtacagcgagattctctcattgtctttttggttgtagcctgtcagcccccaccagaaccactcgccgttcatttcatgcagcggtctgaacagaacggtgacgtcttgatttttcagctgagtaaggccgtcggcgattttgctgagcagcgcctcaagccgttttccttcaacagttgaagggtccagaatgtttttgtactggctgtttgagatggccgttttatagtttccggatggaaaagccggatttgcgagatgcaggctgacctgagggaggccgccgcttttccagtatgagattaagctgctgttgcagctgtaatcgatagaatcggtgatatccgctgtttcaagccatcctctcccatagtcacagccgtagatggcgggagactgtcccgtcgcgtttttcaagcggttttcctctgtcattgaaaaagtgacatcgctgtacccgccgaacgccccggacatgaccctgttttctgaacggttgggcaggtgcgccagccagttcatgatatcttttgtcgtctgctgggcatttgggttgacgggataaacggtgtgagccgatatcggactggcggctcctaagagtaataaaacgatagacaggcagactgctaactttttgagcatataaaagacctcctgatttttaagatgatgaaggatgtgaaacgataacctcacaatctccttctataacaaaatctccggaatccgccggcacgataaagtgatcgcctttgtgaatggggcatccatccagttctccgtgtcctttcatgacgcttgcgagtaaataccggccgggtgcggggaatgatgctttcccgctcacatcccattgataaactgaaaagaaaggtgtttcggcgagtatcgtaataagagcatctccgatccgatgctttgtgctttttacattttcatcggtatggggaatgtctgttacgtcaattgctttctgaagatgaagctcgcgtttattcccgttcccatccgtccggtcatagtcgtaaagccggtaggtggcatcagagctttgctggatttcaagaacgagcgtaccttcacataaagcgtgcagtgtgccgctcgggacatagaaaaaatcgccgggcttaatggggatgcggcggagcaggtgatcccactcgttttgttcaatgagccgaacgaagccttctctcgtttgggcgcgatgccctaaaatgagctccgcgtcttttttgcagtccaacacgtaccagcattccgtttttccgagttctccgttttcatgccgatgtgcatatgcgtcatccggatgaacctgtacggataagtccatatttgcgtcaagaatttttgtgagcaggggaaaagcttcttctttcggatgtccgaacaggtcagggtgttcactccagagacgctgtaatgatgttccggaaaaaggcccgttccgcacaatggatgtgccgtgcggatgagctgaaatcgcccagcactctcccgtccgctcagaaggaatctcatacccgaatgtatcgcgcagcttcgtcccgccccataatctttctttaaaaaccggttccaaaaataagagtttcgtcatttttccgcctcccggtttgccgcctttaatgcgcgctccgccaatacgagcgaaccggccgcgccggagtgaatccctaattgagggggaacgatgaagtgttcaatgtcgggcagatcaatatattgattcagccgctttttcacgtgctgacggatagaagagaacagctgccgctgcttcatgacgcccccgccgagaatgatcttttccggcgaaagtatgagaatatactgcacaagcgcttcggcaatataatagccctcaagctcccacacttcctgctgatccgtgagcaaaaatgcttttttcccccagcgtttctcaatggcggggcctgccgcgaggccttccagacaatctgtatggtatgggcaattgcctttgtagccgtcgtccggatgtcttctgacataaatgtggcccatttcaggatgagacagcccttgaacaaatctgccgttcatgatggcgcccgcgccgatgcctgtgccgaccgtcaaatagaggcagctgtccgcgtttttggccgcgccgaaagaagcttctccaagcgccgccgcattaacgtcggtggtgaagcctgcgggaatatccagagcgcttttgatcgtttgaagaatagggcagttccgccaggctgtcttcggcgtcgcggtgatgcacccgtatgtttgactgtcaggacggatatcaatcggtccgaacgacccgatgccgatggcttctatcgggaaatctttaaagtaacggatcacctgtctgagtgtgtcatccggttctcccgtcggaaactctactctgtccagaatggtgccgtctctttgtccggcggcacagacaaatttcgtgccgccggcttcaatacctccaagcatggccgtccctcctcatctgttaaaatccgttttgatcggaaacggatttgaaccagcggccgctttttttgacggtccgttcgcccccgttttccagattgacagatacaaagccgtagcggtttttataagcatttgtccaagaccagttgtccatgaaagtccacaggtgatagccttttacatttgaaccttctccgatggcccgatgcacccatttgagatgttcctggataaattcaatcctgtaatcatcctgaatgatgccgttttcatcgcggaagcgttcctcgccttctacccccatgccgttctcagaaataaaacactcgatatttccgtaatgttctctgagattggtgagaatgtcgtagattcctttttcataaatttcccacccgcggtgagggttcattttccggccgggcatgacatacgggtcgaagaaacgctcaggcaggaaaggggcatgcggattcggaacatgttcttttgccttgacgcgcctcggctggtagtagttcacgcctaacaggtcgaccgtatgctcctgaatgaggcggagatcttctttctcataatgcggcagaaagccttccgccttgagaatctcgacaagctcctcaggaaattcgccctttacggcgggatctaaaaatgaacggttgaaaaaggcgtcggcaatccgggacgctttgatatcttcaggatgtgagcttctcggataagaaggcgtcagattcagaatgattccgatttgtccatcctgtttcaattctctgtaggctttgacagcccttgcattcgacagcagggtatggaagccggcctgcaccgcttcttgaaaattaacgtgattcgggtagtgaaagtcgtataagtagccgccttcaatcggcacaatcggctcgttgtgagtgaaccattttttcaccttgtcaccgaatagcgaaaagcaggttttggcgtaatgttcaaacgcgtcaacggtgttccggctgacccagccccccttacgctgaagggcgagcggcatgtcaaagtgaaacaaattgacaaacggctcaatgcgatgggcaagcatttcatcgatgacgtcctgataaaacgcgaccgctttctgattgacctcgccagttccgtccggaatcaatcttgaccaggaaatagacagccggaaggagttatggccgatttctttcatcagccggatatcctccttgtattgatcgtaaaaacgtgacgtgtcgccggggccgacgccgttaaaaaaacggctcggctctttttcataccagtaatcccatatgttttggctttttccgtctctgtcagcggcgccttctgtttgggtggcggaggcggaagacccccaccagaatccttccggaaaacgatattgaatatttgattcagtcaattggtttctctcccttactgcgattttgattacatactcatgctgtcatcccgggcatgctgctcggtctcagcttctttttcctttgccatgtttaatttgtccagcgctttaagaaacgggaaccagatgacaaacacaatacagaggttgaccagctgcataatgccgcccatgacggaattggtcgccataatcccgttaatgaaaagggggacggtccaaggcacggtcacgccggtaggagggggcacgatccccgccgacatggccaggtaggtgacaagggtgacaaccatcggtgcgatcacccacggaatgataatgatcgggttcatcacgatcggcaaaccgaaaataaccggctcattgacgttgaaaatgcctggcgcgagaccgagtttggatatctgtttcatctgtttgcttttcataaaaagcaagatggcgatcactatggccaatgtcattccggttccgcccattccgacggtgtaaatctccataaacggcttagaaataatatggggaatctcttttcccgctgtatacgctgccaaattttcgacctgtaatgtattccaaatcgggtccatcacggaattgataatgatttgtccgtgaagtccgaaaaaccataaaatctgaataaagaaaacagcgattaatgtaggaatgatgccgcttccaagtccgacaagcggtgcttgaaccgtatgataaatgacatcatgcagattggtgtgaaagatctgggtgacagccgcattgatcaagaggaagacggtaagcgtgataaaagccggaatcaatgcggcgaacgatttagcaacagccggaggaacaccggcaggcatcttaatcgttaagtttctctgaacgattcttctgtagatttcacctgacaaaaacgcggtcatcatgccgagaaacatcccttttgctccaagccggtcaaccggaatgacgcctgcgaccgctttgcccgtttccggctctaaaacgaacggggtgagcagcagaaaagaaaccaatgcgatcgctccgccgaatacggcctccacttcgtagcttttggaaaggtaatagccgatcccgaagacgacaaaaatggacataatccccatcgtcgccgtcgaagcgccgccaaatccggattgaaagacagacagggcggagctgctcatgattttgtttaaaaacggcaggttcgtcagcacgacgaacaccgaaccgaaaatggtcagcggaaacgccagcataaaagcatcccgtaagacttgcaagtagcggttattgtttaatttgcccgcgatcggaacaaggaattggctgattttctcaaacacgtcttcacccccggctttttataaattctttgattgaaataaatcgagcatttctttgacgagctctttcattgaaagcgctgacattaagtggtcttcagcatgcataaaaagcagagagacatccgtcttggcgccgccggcttctttttgaatcatctgaaaatggatgtcgtgcgctttccccagttcttcttcagcctttgtcagaaaggtgtctgactcatctgtccggccgtctttatatgcgcgtatcgattgaataatattgctgcgggcattgccgctgtgaagaatcagctgaaaactgatctgttcatccgtgtacgtttccatgcttatcgcctcctttatttgttctcaatcaaggcaacggcctgttcgtatgcttttttgccatctcccatgccgtatgccatcatatcaatcacatcaacggtgatgtgaagcgggtccgcctctttctgaagctcaccttttaaaaaactcatctgcgggccgatcagtacgacgtctgcatctttcatcgcttcttttgctttatcctgtccgactgcccaaatctcggcttcctcaccgatggagcgggcgtaattctgcattttcgtaacaagaaggctggtggacatgcctgagctgcaggctaataaaattcttttcatgaggaatcccttctttcataaagttaaaacgttttcatgaatattataatcttttgaaattaaatgtctatacttttaaaatataaagttttacttttcggatttttgacacaaaaaaaccttttaagattcaacttaaaaggtttttcatctcaagcgagccataacagccataaataaagtccgatcaaggtgatgaataacgtcggaatggttaatatcagacctgtcttgaaatacattccccaggaaattttcacgtttttccggctcagcacgtggagccataacaacgtcgccagcgacccgatcggcgtgatcttcggcccgaggtcagaaccgataacattcgcgtaaatcaatgcctctctcatcagcccgtgagtgtccgttccgctgatggctatggcgtcaatcatcaccgtcggcaggttattcataacggaggagaggatcgcagcgataaaacccattccgagtgtgcccgcaaacaatccgtgatccgccgctttctgaataagctgagaaagaagatccgtcagtccggcattccgcaagccgtacacgacaacatacatgccgacagaaaaaaacacgatggcccacggggcgtccttgatgacttgtttcgcagggacggcggggcttcgctgggccagaatgagaaaaatgaccgcgatggagccggcaacgaaggaaacgggtatcgacagcagttcgctgacgaaatatccgatcaataaaacggccagcacagcccacgataaccggaaaaggcgttcatccttaatcgcggatgccggatgtttcacaagaccggtgtcataccgtttcggaatgttttttctgaaatagagatacagcaccaaaatgcttgccgccagagaaaaaaggttgggcaccagcatgcgtgatgcatattcaatgtatccgatatgaaagtaatcggcggatacaatattgaccaaattgcttacaacgagcggaagcgaggtggtgtcggcgatgaatcctccggcgataataaaaggaaaaaccagcttttcaggtaaattcaaagcccgcaccatcgccagtacgatcggggtcaaaatgagcgccgctccgtcattggcaaacagggcggagacaacagcccctaagaccgacacatagagaaacatccgcagcccgctgcctttggccgccatggccatatgcagcgcggcccactcaaaaaaaccgatactgtcaagaatcaatgaaatgataataatggcgataaaggcaagtgtcgcattccagacgattcccgtcacttccgcgatatcgtgcaggctgactgctccggcgatcaaagcgaggaccgctccgccgcaggcagaccagccgattgatacatgtttcggctgccatatgacaaacacaagtgtcagcacaaaaatcagcgctgataaaaccgcaactcccaagaatatatcccccttaccggcatgtaacagtgacttctttttgccgcaatgtctgtaaaacttcgtccttttcatctatctgctgcagaatcgagcaaaccagcgcgtattccggaccggacggatgaatggcatagtaccgccactgaccctcgcgtctttcccgcacaaggccggcgttctttaatttccgcaagtgctggctgatgccgggctgacttatatgaaaaatagctgtcagctcgcagacacaatattccttatccttcagaagcttcagcatcaaaagcctcgtcgggtcgcttagaagtttgaggcactggctgatcccttcggaacttaaagcatgatgcctccgttccatgcgctcactccttttttacactattatataagcagatgtttatataagtaaacgacaatataaaaaagccggccttgcactttttgcaaaaccggctcgtgtttatttttggaacagttttttcgcttcatccattgctaatttatttcccagtgctgaataatcaagccaaggctgatcggcaattttatagacgtggtttgctttcacggccttcagccctttccatacagcgcttttttgcaattctttataggcttgctgtgacttgtcgtctctgttaacgacgacgaaaatcgcatctgcgttgtaatcaggcagcacttcttgagaaatgacttcataagggcgggaggtgttcatttctttaatgccgtcagccggtttcagcttcagatcgtcaaacagaatcggtcccatcggacggcgtgtgctgaagacgcgaagctcttttgcgttcacgcggatcgccatgactttggcgtttttccctaattccttattcatcatggatctgacttgttttgtttcatcttcgtaatcttgaataaatgttttcgcttctttttcacggttgacgatttttccgatgtcttttaaatgatcgcgccatgtgcctttatcaaggtcgaaaacgtgtgtgtttccgattttcttgtattttgacacatcttttcccgcaaattctttatcaagataaatgttgtctggattcagctcaagtaaagcttccatatccgggtctgaggcaggtccgagttttttcgtgtctttcagctgatttttcacatgagggagaaaatcttttaattctccgcccacgacggaaccggcaggtgtaacgccgagagccagcagatcatttgtcaggtgaatggacatcgaagcgattttatgatcgccggatttcttttttgactccggctgtgttgaatcggattggcaggcagccaataagaaaatacacatgaaactgatgagcgcaattatttttttcatgggaatactccttgttttatgatttgattttcatgacgagatagagaaaatacggcgcgccgatggctgccgcaaccacgccggccggaatggcgttcggctgaaacaatgaccggccgatggtgtctgccgcgacaagaatgacaagtccgattaatcccgcaatcgggataatatgctgatgcatggtgccgacgagccgtcttgccaagtgaggggcggcaaagccgataaagccgattcccccggccatcgcgacgctcgcgcaggacaagccgaccgctatggcgatcagcatgatcctttttctctgcacgtgtgcgccgagccccgcggctgcctggtcaccgagcattaaaatattcaaagagcgggcgttaagccatgcaagcggtgcgagaatgccgatccagggcaatagcgaccacacgtgaatccaatccctgccccagacgtttcccaccagccagcgggaagcgaatgtataagtttcttcattcagtcgcagcgacataaacaatgtaacggcgctgaagcccgcggaaacggcgatcccgactaacagcatgcggatcgttaaaaaaccgttcagcctgtcgtacgtaagcactacgatcagcagggcggcgagtgttccgcccgcaaacgtaaacagcgggatgaacatcgatgcctgcgcctccagggaatgaaagaacgtgatatacatcatcaaaccgaaggaagcgccggcatgcagtccgagaatgcccggatcggcaagcggatttcgggatacaccctgcaaaatagcgcccgacactcctaaaccgatgccggccagcatcgtcaccagaatccggggaagccggtaatcgaataaaacggttgtgctttgaaacgtgccgtatccgaacagcgtttttcccaccgtgagaggagaaagccggaatgagcccgtatgcagcccgatcagaataatgcaaacggcgatgaccagcagaatgagtcctgccgccgccgctttttttgtttctttctgcactttcatttataagtctctcccttccttgcgggcaatataaagaaagaaagggacaccgacaagtgcgaccataatgcctatcgccaattccctcgggggactgaccgtgcgcgaggccaggtcagccaaaatcaatagaatcgcgccgagtaacgcggacatcggaataatcagcctgtacgtaacgccgacgatctttcgcgcgatatggggaatgaccagcccgacgaagccgatcgcgccggcagcggaaacagacacaccggcaagaacgacggcgatcattaatccggcggcacgcgtcagagccgtgttcacccctaaattcgccgccacgtcatttcccattgagagaagggtgacggaccggcccatgaatgtcgcgagaatgatgaagaccgcaatcacgggaacaaggacttgtaaatgagcccacttgatccctgacaccccgccggcgtaccagaaggccaaatcctggcttaaatcgtaataaatcgccacaccggtactgagtgaatgtaaaagagcggctacgaccgccccggcaagcgttacttttaaaggtgtcatgctgccttttcccgccgcactgataaagaaaatcaagccggtgcttgccagtgctcccaaaaatgacatcaccatcagcagggcgtatgataaatgagggaaaaaagcaaaactgagcgcaacaacaaacatggcgcccgcgtttacgcctaagacacccgaatcggcaagcgggtttctcgtgacaccctgcatgagggcgccggctgcggcaaaagcggctcctgtaacggccgccccgagcaccctcggaagacgcaattcatgaatgatctgctggcccgttatattcggattgtaatcagcaacagccgaccaaaccgtatgtaaagtaatgtctttcgcaccgaatgagacggcgaaaaaaatagatacaagcagcccgatcacagcgatcaggaagaaaaccccgttttttaagatgctgatcagacggtttgcggacctgacagaatcgctcaaaaatcaattcacctacttttatgatcattatccggtatttattgaatatgagaatcattttcatttgaaccatcatattataccgagccgattttcaaaacgcaatagagcgttcaacaatgatgtcctttttttctctcatgtttatattgtaaaaaagaagtgaaaaacgtgaaagaggaaatcgctatattcagaaaggagggaggcaaatggcgggagaacaaaagcctttgccgattgaattttaccagagaccgtcagtggagcttgcccctttattgctcggctgtctcttggtgaaggagacggatgagggaacggcttcaggttttatcgtggaaacggaagcttatatgggagcggaagaccgggcggcgcacagcttcggcaaccggcgcacgaaacggacggaaattatgttccatgaggcgggccgcatttatacatacgtcatgcacactcatacattaatgaacgtcgtcgccgcggacatcggcattccgcaggccgtgttaatcagggcggcggagcctcatgaaggacagttcctgatggagagcaggagaccgggcagacccccgagagagtggacaaacggcccgggaaaactgacgaaggcgatgggcatttcaatgaacgactacggcggcatgatcacggaaccgccgctgtatattacggagggctttatgcctgagcatatatcaacaggcccgagaatcgggattgacaacagcggagaagcccgggattatccgtggcgctattgggtgacagggaaccgatatgtctcacgctgaccatgtttataaacgctgataacaggggaaagacaaggtaaaagaaaggggattcagacattgaaaaaatttttcaaaacgattatcaaatgggcgcccgtcatctatccgatcatcagaaaaatcataaaagaacggaaggcatctaagcggaaccgcatgtccgcatcccgaacagccggctgatccggctgtttttttacgggcttggcatcggattgccgcattgacttgaaatcctccccattatagaatttacatacatttaccccttcctcattctttttgcccatttttcacgtctgcatctgatctgataggaggtttttctcatgcttcatgggcggcttcgtgaacttttgcgcttgcttttagctgctgaaacaccggttacaagctcagtcatcgctgcaaatgtaaaggtaacgacgcggacggtccgcaatgacataaaggaactgcaaaccattgtagaaaaacacggcgcatccattcaatctgtcagagggagcggctataagctgctgatccggaatgagcagccgtttaaaaactggcttcaggacaatttccagcagaacagcaccgtgccgatttttcccgatgaacggatagattaccttatgaaaagaatgcttctggccgacggctacctcaagctggatgacttggcggaagaactgttcatcagtaaatccacacttcaatctgatttaaaagaagtcaaaaaacggctccgcccctatgacatcattttggaaacaaggccgaactacggctttaagctgcgcggcgaagagctccgcctccgttattgtatggcggaatacttagtggacgaccgcgagcctgagcctgatctcctgagtgaaaaggccggtattctgccgaaagacgacattcatgtgatccgcacagccattatgaagcaggttcgaaaccataagatcccgctttctttcttcggcctgaacaatctcatcatccatatcgccattgcctgcaaacgaatccggacagaaaactatgtatctctcattccggaagatcttcatgatattaagcttgaaacagaatatcagtcagcggaagccatcgtaaaagagcttgaatcggcgctttcggtcacctttcccgaacaggaaaccgcctatatcgccattcacctgctcgggacaaagcgcatgacccagtcacaactggaaggaaaagagcttacaaggctgatagacggggaaaccagccgtttgacggaggccatgattgaagccattgagcgggagctgaagctcggaatcacggacgacaatgagctgaaagcgggtcttgcgctccacatcaagccggcgattaaccgaaaccggtacggaatgaacctgagaaacccgatgctctccgccataaaggaaaattatccgctcgcatttgaagcgggagtgattgcgggaatcgtgatcaaggagcaaaccggcattgatattcatgagaatgagatcggatatttggcgcttcatttcggagccgccattgaaaggagaaagacggaacggccgcctaaacgctgcttgattgtctgtgcgtccggcgccggcagcgcacagcttttaagagaaaagctccgttcccggttcgcaaagcgtcttgaaatcgtcggaacggctgattactgcagccttgaccagctttcctttgagtcgattgattttgtggtcagcacagttccgatcaaaaaagacctgcccgttcccgtattaaaggttcatacgctgttgggcggcggggattttacaaaaatcgacgccatgctggaagaaaagcgggaacaattgaactttctgaaaccggagctggtatttttgcagcaggatctggagacgaaggaggacgtcatccgttttctcggacagcaggttgcagaagccggcctcgcttctgattctctgaccgattctatttttgaaagggaaacgatttctcctacgagtttcggcaatcttacggcgattccgcacccgctcgttccgcagacagacacgacgttttgggcggtatgcacgctgaagaagccgattgactgggcggataagcgtgtccaatttgtctgcctgctctgcgtcgagaaagaaagcaaagccgacctccagcatatgtacaaatggctcggcggcatgttagatgatccggccgcggtaagccgtctcttaaaatgcacaacctatcaggaggttttacgagtattcagagacaaacgatcagagaaagaccgggatacaccttttttccgttaacagcggaaaaagcctgagtagttatgaaagcgatttcataatatgatggtactaacatcgagacatacaaaatatcaaactttcaggaggtcttttacatgaatatattactcgtttgtgcagcagggatgtcaacaagcttactcgtcaccaagatggaaaaaagcgcgcaggaacaaggaaaagaatataaaatctgggcggtgtcaggcgattcagtcaaccagcatattgataaagcggacgtattgctgcttgggcctcaagtccgttatttgcttccgcagctgaaaaaattgggtgaatcaaaaggagtgccggttgaagtcatcaataccgtccattacggcacatgcaacggagcggaggttctgaaatcagcggaacagctcggaaacgcatcgtagaaaggggcgggccgtgtgaataaggtgaaccagtttttagaagagaaagtcatgcccattgccggaaaaattgcctcccagcggcatctgcaagcattgcgtgacgggatcatcctcaccatgccgcttattatcatcggttcattttttctgatcatcggcaacctgccgattccgggatatgcggatttcatggcaaagacgttcggaagcgcctggtctcaaaaactgcaatatccggttgatgcgacctttgaaatcatgggtcttgtcgccgctttcggaatcgcctaccgcctggccgaaaaatacggggtggatgcattatcggccggtgcgatatctttggcggcgtttctcttggcaacgccgtacaaagttccgtttctgccttccggcgccaaagaggaaatcatggtcggcggcggcatcccgctgtctctcatgggaagcaaagggctgtttgtcgcgatgatcatcgccatgctgtcgacggaaatttaccgcctgatcatccagcggaatttcgtcttcaaaatgccggacggcgtgcctcctgcggtcagcaaatcgtttatcgctttaattcccggctttgccgtcatctttctgatctggggcgcgcgtttaattgtcgaagcgacaccgtttgaaagccttcataacattgtaagcgttgtactgggtacaccgctctcgattcttgggggaagtctcggcggaagcctgatagccgaagcggttcaaatgctcttgtgggcgtgcggattacacggggcgaacatagtcggcggcgtcatggcgccgatctggttcggagcgatggatgccaaccggattgcgtttcaggcgggcgatgcgcttccgaatattttcacccagcagttttttgaaatctggatcaacatcggcggaagcggcgcgacactggcgctcgtggtcaccatgtttctccgttcgcgaagcaagcagatgaagcagcttgggaaactcgccatcgggccggccgtctttaatattaatgagccgattattttcggaatgccgatcgtcatgaacccgatgcttctcattccgttcattatcacaccgcttgtcacactggtccttacctatatcggcatgagcactggcctcgtcgccaaacctgccggcattgccgtcccatggacgatgccgccgattttctccggctatcttgccacgggcggaaaaatatcaggggctgtcatgcaggcgattaacatcatcacagcctttatcgtgtactatccgttcttcagaatgtgggattcgcaaaagctgaaagaagaaaacgaacttgaacaatcgcaggcgccagccgtacagggagacgaaaaagccgtgctgtagagaaagggagtgaaacacatgaatgaaaaaatggaacagaccatttttcagatcatcctgcatggcggcaacggcagaagcgcatcaatggaagccattgccgccgcaaagcggggggacagagccatggcggaagaaaagcttcaggaagccgcaagggaactgacggaagcccatcattatcagacagaactgatccaaaatgaagccggcggagaaaaaacagacatgacgcttttaatggtgcatgcgcaagatcatttaatgaatgccatgaccgtgaaagacttggccgctgagttagttgagatttacgaaaaagtgagtctgcaagggggagcgaaaatatgacaaaaggaattaaaattgtaacgatcggcggaggctcaagctatacaccggagcttgtggaaggcatcattaaacgctatgaggaactgcctgtcagagaattatggctcgtcgacattcccgaaggcgagaaaaaactcaatatcgtcggcacgcttgcaaaacgcatggtcgaaaaagcgggtgttccgatagagattcacctgacgcttgaccggagagaagccttgaaggatgcggatttcgtaacgactcaattccgcgtcggccttcttgaggcccgcgccaaagatgaacggattccgttaaaatacggcgtaatcggccaggagacaaacggtccgggcggtttattcaaagggctgcgcaccatcccggttattctggaaatcgcgaaagacatcgaagagctttgtccgaatgcatggctcgtgaatttcacaaaccctgccggcatggttaccgaggccttgctccgctactcgaatctcacaaaagtcgtcggcctctgcaatgtgccgatcggcattaaaatgggcgtcgcaaaagcattggacgtggatgtcagccggatcgaagtgcaatttgccgggctgaatcacatggtcttcggattagatgttttcttagacggcgtcagcgtgaaagatcaagtcattgaagccatgggagacccgaaaaacgccatgacgatgaaaaatatctcaggcgcggaatgggagcctgaattcctgaaggcgctcgatctgattccttgcggctaccaccgctattatttcaaaacgaaagaaatgctcgagcatgaaatagaagcgtcacagacggagggcacacgcgccgaggtcgtacagaaggttgagaaagaactgttcgaactgtacaaagatccgaatctcgccatcaaaccgccgcagcttgaaaaacggggcggagcgtactacagtgacgcggcctgcaacctgatcagctccatctataacgacaaacatgatatccagcccgtcaatacgataaacaacggcgcgatcgccagcattccgaatgactcagcggtcgaagtgaactgtgttatgacgaaagacggtccgaaaccgatcgccgtcggtgatctgccggtgtctgtccgcggactcgtccagcaaatcaaatcatttgagcgtgtcgccgctgaagcagccgtcacgggagattatcaaacggcgctacttgcgatgacgatcaaccctctcgtcccgtcagactccgtggcaaaggccattctggatgaaatgcttgaggcccacaaagaacatctgcctcatttctttaagtcgattgaagcataagagcagtaaaaaaacccggattcgcttccgggttttttgcttattttgtttcgcttagtgaggcgacttccgtcgtccagccgaacacgtcggcttccgcgcctttttgaatgcctgtaatggtatcatacaatttcttcgagatctctccggtttcaccgctgccgatgacaagactttcatcattccagatcagttcgccgaccggagaaatgaccgccgccgtaccggttccgaatgtttcttccaatcggccgtcacgatgcgcctggatgatttcatcgatcgaaatcttccgctcagacacagtcagtccccaatgtttgagaagggtgatgacggaatttctcgtaattccttcaagaatgcttccgttcagctccggcgtcacgatttcgccgctgattttgaagaagatgttcatgctgccgacttcttcgatgtattttttctcaatgccgtcaagccataaaacctgggaaaatcccttctcttccgcaacctgctgcgccttcaggcttgatgcatagttgccggcggttttcgcgtttccggtgccgcctttgacggcgcgcacgaattcgttttccacggcgatttttaccggtttaatgccttctttgtaataagagccgaccggggaaagaatgataaacagcttgtacgtatgggatgccgctacaccgaggaaaggctcagtcgcaatgataaacggacggatataaagggaagtgccttccgctttcggaatccagtctttgtcgatggctacgagctgtttcaggccttcaagaacaagctcttcatcaatgagcgggatgcaaaggcggtcatttgactggttcaggcgctccatatttttctccggtctgaacagaagcacttcctgatccttcgttacatacgctttaagcccttcaaaaacggtttggccgtaatgataaaccatggccgcaggatccattgagatggactgataagggataattctcggatcataccagccttgatcggcgtcgtaatccataacaaacatatggtcggtgaaaattctgccgaacgcaaggtcatgggggtccggtttcggttttttggctgaagtcaattcaacacgaatgtcttgtttcatattgttctgtctccctattggtgttattgtcaaacttatttgaaaataatttatattctattgtataccttcaacaaatattcgcaatagttttcctcaaatttgtgaaaaaatcaaatcacataaaaagcaggggagagaatgccccctgcgtgttcgtttttacgtattctgtcatcaccgtgctcagtgaaccgtcaccttgccggttttgtaaaactgctccattgctttatcgacgtacacccagcccttccaggcgatatggatggtgtctttcataaagtacggatcatattcgtgcccggataagtcggcaacctgaaagcccttcgctttaatttgcttagtgacttttttgtagtaatcagtccggccttttttcgggaagccggtgtagtcataccattttccgttgaccggaataaccacgaacatcggttcagcgccggcatctttcagaatgtccagcatatcctcaaagtcgtgatattcgactgatttggcgtatgttcttcctttgttgattcctttcactctctttactttcttcttaatctttttataagaagcgtcatcgatatagaaaggattggacttggagctccgttctcctaattgagcggcggctgtttttaactctgaccacgatttccctttcaggttttcagagatcgtccgttcagggcccttggtttctcccattgaataataaagatcttttttctcaagcagagaataataagctttggcagccggcatgaccgctttcactttccatgattgtccgttgaccattcccttgtacaattcagaaaggacggcatcatgctgaacgactttaaaacggagcatgcgcttcatcatgttctttttgaccgcgggatcaatctggttattaaatgctaaatccaatgcctgaagtgatgaaaaattcggcgcaaagtgctgttcatcagaaccttttttgataaaccattgcggagaaacaatgaataccagttttttgcccttcagctgctgataatgcgccgcaaagttcacggcgtgtatcaaggattggtccccgccttttccgactagataaggcgtaaagccttggttgttcacttggaaatagttggacgggtgaaactcatccagtcttgaaagctcggaagaaccgaaaatcggcagatacttcgagtcttcgaacattttgttttgaagatagagcccctggaacatattcggatttaaggctgccgccgactcttcgacacgtttttcaggaatgaagcgcgtaagccatgaagccggaactgcgatagctccgacaaacaggacgaacgctaaaataattggtccaaagaaacgctttttcatttacttcaactcagtcagtttgtttacaatgttgtttggcgtattccactcgtcacggtcaaattcagtgatcggcactgtaatgccgaagcggttttcgatggcgacaagcagctctacagttccgaaagaatcaagcagtccttcttcaaagatttcaatatcaggattttcttttacagcgtcctcctgacaaacttcagctaatacgtctaatacttcctgtttaaattccatgtgttttcaatctcctttagtgatgaaatggttttcctgagaaaatataaaatccgaaacatacgaaatggaatgtgatgacgatggctaaaaaggccgtaaaacgattggcgggcagccacttgtatttcttattccatttctcaaaaaagttatacccggtcattaatacggcgtggtacaggccgtatacaatatattgcagagcgagtccgtgccagacgcccatcagcatgaacagcaggaaatacccgatgttcgagacggccatccggttctttatccattttttctttgtcatccagaaaacaaagcgcataaatacgtagtctctgaaccagaaggataaggacatgtgccagcggttccagaagtctttaatgtttttgctgataaacggcttattaaagttttccggagatttgatacccatgatatagcttacaccgacggcaaacatcgtgtaacccgcaaaatcaaaaaacaggtacaagctgtatccgtacatgtacagcacattaccccacagtttgctgtgggtgatatgagacagattcataatgaaatacgtgttaatcgcatatccgataatgaatttgtataagaaaccgataaaaattttatgaatgccggtatacagtaaatcagcgtattctccctttgtccatactttctgttcgtccttggcaaatctgcggtatctgtcgatcggaccggaagaaatggtcgggaaaaacataataaagtacaaaaggcggtgaagcggcattttttctttaatcagtccgtctctcgtttccatgatcagctggacgcctttaaatgtcaaataagaaattcctaagaaactgatcaggttatgaaccgggtgatgaggcgccggcggaaagaaaaacggccataatttagataaaaacaggggtaaaatggacgcgatcacggccatactgaagacaaagccgctgttggctttcagtctgtaagcgagataacccctgattaaaagcacctgccacagcgtaaagatacatagtgcgatcacgccgtgcagatcatgcgcgaaaatcaaagccaatacgatgatggatataaacatgttgtatccttggaatctcttgccgttcagccctaaaataatcgtcggcaaaagaaggattccaagtaagataaagaagaaaaacgagctgtaaggcgtcatacaagaacctcttcgccaatgcgtttacggtcgatttttccgttcgcagtcatttgaatgtgatcctgataaatgaattttctcggaatcatgtaggccggaagcgaagcggccagttctttcttaatggcgcttgtcagctggaattctttttcaaaatcatgtttttcaggcacgatggcggcaattagatattcgacaggtccgttaggctgatacgggatgacaaccgccgtgcgcacatattgagactgccttacatgtacttcgatttcctccagctccatgcggtagccgtgaagcttaatctggaaatcaaggcgtccttggcagaaaatctgaccatcctgaacataaccggcatcacccgtgtgatatgcccactggccgtcgatcgggaaaaacgctttttccgtcagagaaggttctccgagatagcctttgcttacgctcgggcccgcgatgatgatttcccctttttctccgtccggaagcttattcccgttttcatccatgatgaagatatccatatcgggttttgcaaaaccgacgggcagggattcattttcatcgatgatctgctgcgtaatttcaacggaggtgacggcaaccgttgtttcagtcgggccgtatgtattgaatacgcgggccttcggaaaacggtttaacagctcctgtgccacggcagccggaagcgcttctccgcaaaacataaatacttctgcctcaggcaggagctcctgcgtaaagccggggtccatcagacacatttggacgaaagacggcgtcgatgtccagacgttcagtttggatttctccagctcttcaaatagtactttcggtttattgattttgtctttcgttacgcaatgcagcgtacctcccgtttgaagcgacgggaaaatgtccatgacagataaatcaaaagaaaacggagcttggtttaagaatgtcttacccccgcccacaggaaaatccctgcagatccagtcagtaaagctttgcaggttatcagccgatatctgcacgcccttcggatttcccgtgctgccggacgtgtaaataatgtaaaacgtgtccagctcttttacccaattctcacggctgaggtctgcatctccgtcagctgcaagctcttcgggcgtaacggttttaatcagattgcttcccgtatcgactgcatcgcccgatacgctgataagcagctctgcgcctgagctttcaatgattttgacgatccgctccgccggaatggaaacatcgacagggatgtaagggcggcccgctttgacgcttcctaagaaagaaacgatcatattcggctccatatgtccgtaaaccaggacaggcgctttcgaaccgtcagctgtatgtttttgaatgccggacgcaacccgctccgacaaatcccataattccccgtaagtgagggaatgatctaaggaacgaaacgcttcggcctgcggcttggcgtctgcatatgtttttatagcatcaagtagtttcatagttatcctccccgattagaaatcgttgtaaatataagtgccggtattcgctgtatgaaatccatacatccaaaagagcaatactaatatcagaaaataaaagcccgtatgaaacgtccatttgatcaatgtattttcataagcacgttttaatttttgcaacatattcaaaattccttccccgcgtattcaataattacaccagtatatgacgattagattaacaaaaagtttcaaaatatgtctaatatcctaagcttaaaatttccttaaaaatgaatgagaaacaaaaggatggaaaacacgcatgtataaattggcaaatgatcatactaaaaaggcgctgttcaggcgggatttttaacttatcgtaaatataaacgaggtaaaaaaattttggcggctttttcttaagcaggcttgtgccgaaccccaatggagaagggcgaaaagccgtttccggcaggatagccgataaagcgccgcatcttgtgaaatgaggaagaaattattatgatagataaggtagcagaaaacgtgaaaaccccaattcaacactactgttatcggctgactgtgaaagccttttaatagaaaggaagaggaaaatgaatcaaaacaatatggggggcagccaaaagacgcccgagaaagaaagcatgggccgcattttgtggcagctaacccgccctcatacattgacggcatcgtttgtgcccgtacttctcggcaccgtattggcgatgttttacgtaaaggttgatttcctgctgtttttggccatgctgttttcctgcctttggatccagatcgccacgaacttattcaatgaatattacgattttaaacgcggtttagatacggaggattccgtcggtatcggcggagcgatcgtccgccacggcatgaagccgaaaacaattctgcagctggcgctcggctcttatgcgattgccctcgtgctcggtgtttatatctgcatgagcagcagctggtggcttgcggctatcggccttgccggcatgctgatcggctatctgtatacgggcggcccgctgccgattgcgtatacaccgttcggggaactgttctccggcatttgcatgggctctgtatttgtccttatttctttcttcattcagacaggcagaattaatgaacaaagcattttgatttccatcccgatcgccatcttggtcggagccattaatctgtccaacaatatccgtgatattgaggaagataaaaagggcggacgtaaaaccctggccattttgatggggcatagaggggccgttatgatactggccgcatcttttgccatcgcttacatctggatcatcggtcttgtcatcatgggttacacaagcccgtggctgttcctggtcttcctgagcgtgccgaaacccgttcaggccgtgaaaggctttgtgaaaaacgaaatgccgatgaacatgattattgcgatgaaatcaacggcgcaaaccaatacattcttcggattcctgctttccatcggactcctgatcagttatttccgctgatcaaatgaaagggcaaatgccataaccggcatttgcttttttttatgacataatcttcacgatattgtaaagaacctgaccgcggactgacacgtctcatatatggacagcaaagcaaggagatgaaaaaaatggacttgtcaacagcccatatggatgatttgaaaacggtcatggaagattggaaaaatgaattattagtttataaattcgctttagatgagctggatacgaagttttctatcatcagccaggaatataatctgattcacgggcataacccgatcgagcatacaaaatcacgcgtgaaaagttttgagagtatcgtcaataaactgatgcgcaaaggctgcgatgtgacgacgcaggaaatgaaagagcatattcatgatattgcgggtgtcaggattatctgttcctttatttccgatatttataatgtcgctgaggttttgaagcagcataaggacctgaagatcgtaaaggtgaaggattatatcaaacatccgaagccgaacggctaccgcagcctgcatttgattattgaaattcccgtttatttgacgaatcgtgtggaatatgtgaaggcggaaattcaaatccgcaccatcgccatggatttttgggcgagtcttgaacataaaatttattacaaattaaataacgaagtcccaaagcatctgaccgacgagctgaaggaagcggcggacatcgcccattatttagacgaaaagatgcttgggattaagaaagaagtcgattaaacgattgacccatcacaaccagccggaccgcttttatgtgcagtccggctggttgtttttatgtttacgtgttttcgctttcccgcgcgatttattctgacgatgattcaggctgaaattctgattgaatttgaacagagaatgcaaaagatatcaaatcgcaaacagcacattcccgcagaaaaaatgtgtaagatcgaggtttactttttttaaaaagggaaagacatttgtacaacaaaaagggagatgaatatcagtgggaaagaatgaaacaatgcatatcgtatcatgtgccgatgatcattatgctcgtcatttgggtgggatgttcgcttctttattgatgaatatggataaaacaagggatgcgaaattatatgtaatcgacggcggaattactgccgaaaacaaggacaagcttgaacagaccgcgatgtcattcgggacgccgcttgaatttttagaagtagacgctgatcaatacaagcatgcagtcgaaagcagccacattacaaaagcggcttattaccgcatttccatccctgatttaattaaggatgagtccgtaaagcggatgatttacattgattgcgatgcaattgtgatggaagatatttcggttttatgggacttggatatttccccggcaatagttgcggcggtagaagacgccggacagcatgaaaggctgaaaaaaatgaatatcagcgacactgccaagtattttaattccggtattatgattatagatttcgaaccttggagaaaacaaaatatttccgaaaaggtgattgattttattaacgaaaacagctcggaggattttctcgtgtttcatgatcaggacgcgcttaacgcgatcttatatgatcaatggcatgaactgcatccgcgctggaatgcgcagacgcatattatcatgaacgagaaaacgcctcctgaactgatcgaccgtatacgttatagagaaacacgtgccgaaccggccatcgtccatttctgcggcagcgacaagccttggaatacaggcacctcgcacccgtatcgtgatcattatttccgatatatgtcctttacgaaatggaacacgatcgaccgcccggccatgaaccaataggcaggtgtgatgaaacgcttgtgaagccgttatccggctcataagcgttttttgctatttcacccgaatcgcacgcacgcgtttttgcaggctggtcttttcggcagacggcttcaatcggctgactgccgtttgcgccgctgattttgcttttttcgtctttgttttttcagccgtttttactttgtctctagcctgctgccggttgagtttatcttttatccggtcaagccgtttttccagagcggttttttcttttcccggctggatttcgctgactgctttttgggcttttgcggtgctggcctcagaggtctttttttccgcctgcttgacgctggcctcagctgttttcaaaaggcttgagttgacagcgttcagccgcttttgcagcccttttttctctgaaccggccggtaatttgcgaatggcgctttgtgcggcattgacggcggtttttttcttttgtttttcggcagtccggactttgtctcttgcgtccgtcacatttcttgccgtctgaactttattgatccgggactcgagagcggtttttccctttgacttggacagcttgctgacggccgtttttgcttgattgatatctgcctgttttttcgtcttttccgcttttattacggtccgttcggcatagctcttttgctttacatgatattgcaccaggccgtacccgaatcggctgtcacgtccgggagcgcccagatctttgacgttttgctgcatctgctgccggagctgtgtatttgtttcctcgggatatttctgcctgagcagcgcgaacatgccggtgacgtggggcgcggcttgagatgtgccgtcagccgtggcgtacatttgattcagatacgtgctcgtaatattggtgccgggtgcggcaaactcaatttgttttccggtcgtggaaaaagccgcgagcccgtttttttcagttgacgctgagactgccgttacgctgctgtaggcgcccggataattgacgggttttttgttgccgtcgtttcctgcggcggctacgatcacgattccttttttgtatgctttgtctacggcgtcgtgaagaattttgctgtctgcgttagttccgaggctcatattgatgatgtccattttattggcgatcgaccagtcgatcgctttaagaaggcttttaagatcccctgcaccctttctgtctaatgccttaactgcatataaccggacatccggcgcgatgccgtcaatgccgtatccgtcatgtttggccgcaatgattccggcgacatgcgtcccgtgtccgttgtcatctttgtatgaggaagtatagctgactgcggaatagcctccggcaatggaaaggtcatcatgagggtaaatgccgctgtcaatgacagccactttcaccttttttcccgtcaagccttctttccacgcctgcttgacctgagtcggttctatatcccattgcggcagcgcgtaactgctgctttgggccgctgataacgggcggatatcagaaccgcctgctgcctgaaaggatacattgtcttctacatataagatgtcagggtcctgtttcaggtctttcaccgtttgtgaatcggctgacacggcgactgccgggagatgctgataggtctgttccacatccgctccgctgtctatggcggattccttgccgttttgatttttgtacaccacgataacgtcccggtcgtgcgtctcggcgtgcgcgggcgccgcggcggagaacaggccggcgcacaaggccgcggccattatcggtttcagggtgtgatacattgcaattccccctttttctttatatatcggcagtgcggaattctttttttcctgagggataaggaaaatttctgtatgcaaatgtaagcgtttccaaaatatgatggagaaaatgctttaagacatctgcgcaatgaactcaaaaagggggtttttgataaatgagtacgttcaatcgggtcatggaagaaaaaatcatgcctgtcgccggaaaagtcgccggccaaaggcacttaagagctttgcgggacggcattattttgactatgccgcttatcatcatcggatcggtttttctgattctgacgagtcttccgattcccggttatgccgattttatggctggtcttttcggtgaaaattgggttgaaaagctcgggtatcccgtgaatgcgtcctttgacattatggcgcttgtcgccgcctttgggattgcctaccggcttgcggaaagctatgaggtggatgccctgtcgtcgggagccattgcccttgccgcctttttattggcgacgccgtatcagattccgtttattcctgacggctcggcaacagagattatggtgggaggcggcattccgatttcgctgctcggaagcaaaggtctgtttgtcgcgatgatcattgcaatgctgtctacggaagtgtaccggtttatcatacaaagaaatatcgtcattaaaatgcctgacggagtgccgcctgcggtcagcaaatcgttcgttgcgctcatccccggtttcattattattacgcttgtatggctggcccgtctgtttattgaaataactccttttaaaagcctccacaatgtcgtaggcgatctgctgggcaccccgctgtctattttgggcgggagtctcggcggaagtcttatcgccgaattcgtgcaaatgctgctttggtcgtgcggcatacacggcgcgtccattatcggcggcgtcatgtcgccgatctggtacggggcgatggatgccaaccgtttggcttttcaggcgggagaagcgctgccgagcatttttacgacacagttctttcaaatatggattaatgtcggcggaagcggagcgacgcttgcccttgtgctgaccatgcttgtgcgctccagaagcaaacagatgaaacagctcggccgtctcggaatcgggcccgcgatttttaacattaacgaaccgattattttcgggatgccgctcgtcatgaatccgctgttaatcgtgccttttatcattgcgccgctcttgaccattacggcgacgtacatcgggatgagcacggggatggtggcaaaaccggcgggaatcgccgtgccgtggacgatgccgccgctgatttccggttatttggcgacgggcgggaaaatctccggttcggtcatgcagctgatcaatctcctgattacatttatcatctattatccgtttttccgaatttgggatcttcaaaaatggagagaggaacgggcggcggaacaaaacgtcactgaagaaacataaaaaaaacgggctctttcgcccgttttttttaacgctggaaaaattcgatccattcgccgtcaggtccttcaatgtaaaagtagcggtacccgttcggaagcgtcgtgatttcttcatcgataaatacggcgccctgacgcttcgcatgcgtgaactccgccgcgatatcttcagttaataaagcgacatgatggacttttccttctgcgggaagctcgctgctgtagccctggatcagttcaatttctgtctccggcccttcttgaaagccgagaaaggcaagttcaataatgccgttcgtatgagtgatacgatcctttaactgcataccgagaacatcttgataaaaggcgatggatgtttcaatatctttgaccataatgcctgtatggtcgattcttttggctgtcatggttttccccctgttttgaatttttcgggacaatgcggtgttgatcatgttttatggtacgataagagaaagcaaaacgaaagaggaatgcacaatgaagctacttacagtgaaagatacatttgccggaaagctgaaaaaaggattccccctgattgaaaaagacgctctgtccggaagctcggctcatctaacagagggcgatctttttgatgtgacatccgagaagggtgagtttatcggaaaaggctattacggtttgcagaataaaggagtcggctgggtgctgtcccgcgcgagagatgaacggatcgacggacgtttctttctggacaagctgaaaaaagcggctgaagcgagagctcatctgtttaaggcgcccgacacgacggcgttccggcttttcaacggtgagggcgacggcatcggcggcgtcacgattgacttttatgacggttatctgctgattcaatggtacagtaaaggcatttacgcttataaggacagcatgattgaggcgattgacggactggagctttcttataaagcgatctatgaaaagaaacgattcgatactgccggacaatacgtggaagacgacgattttgtcaaaggcgaaagaggagattttccggtcattgttcaagaaaacggcatccgatacgcggtggatttaaacgacggggcgatgacgggcattttcttagaccagcgtcatgtgcgcaaagcgattcgggacaagtatgcaaacggcagacgggtgctgaatacgttctcttatacgggggcattttccgttgcggcggcgcttggcggagctgataaaacgaccagcgtcgatgtcgccaaccgcagtctcgcaaaaacgattgaacagttcagcgccaacggaattgattatgaggcgcatgacattaaagtcatggatgttttcaaatacttcggctatgcggcaaaaaaagggctggagtttgacctcatcatccttgatccgccttctttcgcccgcacaaaaaaacggacgttcagcgcggcgaaagattataaaaatctgctgaaggaaacgatcgccatcaccgcaaaaaacggcatcatcgtcgcttcgacaaacagcagcgccttcaatatgaagaaatttaaaggctttatagagaccgcctttaaagaaacaaatgagcgttacgacattttggaagaatacacgcttccggaagatttcaaaacgattcccgcgtttaaagaagggaactatttgaaggttgttttcttgcggaaaaaatagaatgaccatttatagcgtggaaagaggggaaaagaaaaccctctttcatcgcgttaatacgggataaaataatcttcatatcttaaagaaacaacccgctattacttagtatctcatctgtgctaagtaaagtggcctcactaatccccacattgttggctttcatgaaggattgcaccgcttggtagccaaccgcataacctgcaaacggtgataagccgacaggctgataaccttgttcggctgcaaaggtgtcgccaaacatgtaactgctgacctcagcaaatcctttcatatttaatgagtctttgatgatttcttttgagtattctaagtcttctttttcaaaagaagtaacccagggacctaacagagcttctccgtaaagttctttagcaaacgattctgccaacccctctataattaagtaatcaccaaccgttacgttcccataatcccaattgaaatacgaaaaatgaatattatgatgaaattcatgtgcgattacagcaggcagtctcggtatgttatatgaattggggaatattgaaacttgaataaatcccggaattcctccgaatccacaataccctctatgtaactcaagctttttttgattggccagatacatcccaaaccttatttcatcagcatttatttttaagcggttttgtttgataaattctacacaatgagttaaagtgccatatgcaatttgaagagcttgaatttcttttagattctctaatgcttttcttccggtgtccgtatcaaatatgctcagatagcccagcatatttgtagccatgattacatcatatccgttaggttgctttgcctttaagggaacattaatctttttccacatatcttcaaaaggtttcatcattgaataccgataataatcttctctattttcaatcattgaaaataacgtttcgtattgcccaattgtatcctcgataatgattttaatgggtaccaccctttttttgatgatctatataaattgtaatggcatcactcatgagcttcgccaacccttcaccatactgatcgatgttcttagtgaagcgtttatcttcaatatagagttgacctaatccgtaaaaggcatcaaaagaatattcaccaaaattttcattgagaaaatcaaaccactctttgatagctgtttgtacttctggggacttgggagattggttaataaggagtgcaaatttattgaacattgcagtccacttatcagataaatctttttgctcaccatcagtcatgtttttcaatctaatatttaccgtatcgacaggttgatcaccccaccgtttgcgagcttcttgttcataaagattatgattgaagttcattccctcaaaccgctctttgttcgtcatgcaaatttctcccatcatatgtttgattgatttatcgatggtttcaatcattttatcaactctattccgtttctcaatcaacattttcttttgtaaaattaatgcctcccttcggttaaatgaaggactattaatgatttctttaatctcttttaaggagaaatcgagctccttgaaaaatagtatctgctgcagctgttcaagattctcttcagaataaagccgataaccggaatctgtcgtttcctgaggagtcaataatctaatttgatcgtaatgatggagagtacgtatgcttactccaatcagttcagctacttcttttactttcatacccatcacgtttgccgcctccttaatggctactctaaagtattacgcaacgtaagagtcaatagttagttaaagattttttgtatataaagggagaacatatgaggatttcattgctgaaattaaagaaaaaaagccgggcgtgaagctccggcttttttctattcaataatgtgctgcacccggccgattcgtccgtcttcaaggcggaccttaatgccgcgcgggtggaagcttgagttcgtcaaaatatccttcacgattcctcttgtcagctttcctgaacgctgatcggctttcaggacgatatcgacttcaagtccttttctgatgctgcttcgctgctggccgttcatatgacacatccgttcttcagtcttttcacttcatatcttatcatatcgtgttttccccattttatgaaggacagacgaatcaatccttcatagcaaataaaaaaagaccgctctgtaaggagcagtcttttatgacataaacgaaagcaaaatcggggccgcgcacagcgtcataattgcggcgagaatcatggacacgcttgagatcgttcctgatacggagctgagctcaaatgctttagatgttcccgctccgtgcgcgctagttccgagcagcacgccccgggcaatttcgttatcaatgcggaaatagcggatgaccatcggcccgatgatcgttcccaataaagccgttaaaatgacgaaaaccgctgtaacggccggcatcccgccgatcatttctgagacgttcatggcaatcggcgtcgtcacggatcgcggcacgagactgtcgactaagctgctgccgagatggaaccatttcgcgataaaggccgttgacagaatggcgatacatgaaccgaccgctacgttcaaaataatttccacggcgtatttctttaaaatcgggaaatatttataaagcgggatagcgaacgccactgttgccggctgaagcatatcggtcagcagtccgccgccgagattgtatgtctgatacgggacattgacaagaagcagcagtacgaccaaaacagcgggcgtaatcagaagcggcgacgtatacacccgcggaaaacgaatgtagagttttttcgcgcccaaatatactaagacagttaagaataaacttatgattccgatgaacacgtttgttttttctcctttctttttgctatcagctgtgtaagcgtacctgttgaaaccatcacgacaaatgtgctgatgacgacgacaagtaaaatgcttacgccgaatttagacataatatctccgtattcaatcactccgacggcagacgggatgaaaaacagcagcagctcaccgaggagccatgctgcgccaagctcaatccattcaagtttgataatcttgaaatgcaataatgtgaaaagaatcacaatcccgattatactgccgggaatatttatatgaagagccgccgtgacccaattgatcagacgcgcaaatataaacagcagagcgatttgaataacggtaagcagcaattttttcataatgatgcctcccttatatttatattgtacagaaggttttgctataggtaaaatacatataaagaataatgtgtattccttttgtctatagaaaggatgaaatgtaatggatatccggcacttaacgtattttttggaagtggcccgtttgaaaagctttacgaaggcttcacagtctctgtatgtttcacagccgacaatctcaaaaatgattaaaaacatggagacggagctcggcattaagctgttttaccgcaatggccggcaagttgaactgactgacgccgggcagagcatgtatgtgcaggcgcaggaaatcacaaagtccttccaaaacctgacgtcagagctgaacgatattatggaagtgaagaaagggcacgtccgcatcggtcttccgccgatgatcgggtccggctttttcccgagagtgctcggtgacttccgcgtcacatatcccgatgtgacgtttcagcttgttgaggacggctctattaaagtgcagcaaggggtggaggacggctcgcttgatatcggggtcgtcgtacttcccgcgaatgaagagatttttcatacgttcacaatcgtcaaggaaacccttatgctcgtcgtccatccgtcacatcggctcgctgacgagaaagaatgcagtctccacgaattgaaagaagagccgttcatatttttcagggaggattttgtccttcataatcgaattatgacggaatgcgtgaaagccggattcaggcctcacgtcatttatgaaacgtcacagtgggactttatcagcgaaatggtatcggccaacctcggtatcggcctgctgccggaaagaatctgccgcggtcttgatcctgacaaagtcagaaccattccgctcgttcatccggtcattccgtggcatttagccatcatttggcggaaagaccgctatatgtcctttgccgccagagcctggctggagcatacgaaatcgtatttatggaatccgaaaaagagaaaaaaggatgattaagcatggacgcacaaaccgcagctcaacacttgagtaaagtgcgggatcaaaacccgctcgttcacagtatcaccaataatgtcgtcacgaacttcaccgctaacggactgctcgcgctcggcgcatcgcccgttatggcttatgcaattgaggaggccgccgacatggcgaaaatcgcaggagcgctcgtcctgaatataggcaccctcagttcggcgtcggttgaagctatgatcgcagccggaaaatcggccaatgaaaacggcgttccggtcatttttgatccggtaggcgccggcgccacgccgtttcggacggcatcagcccgcaagatcatacaggaggtccgcttgtccgtcattcgcggaaatgccgcggaaatcgccaatattgccggcgcccctgattggaagataaaaggtgtggatgcgggggaagccggaggagatgtggttcagctcgctaagacggctgcaagcgggctgaagacggtcattgcgattaccggaaaaaccgacgtcatctccgacggcaccgacacatacgccgtacataacggtgataaactgctgacgaaggtgacgggggcgggatgcttgctgacgtctgtaatcggagccttctgcgcagcggggcaggacgttctgcaagcggccgtttcagccgtttctgtatacggaagcgccgctcagcttgccgctctggacacctcccataaggggccgggcagcttccagattgagcttttaaacaagctggcaagcatctcagaacaagaagcggccgagcttgccgcaattgaaagggtgacagaaaaatgacgcgtatttctcgggaaatgatgaaggatatgttatcggtttattttattatgggatcaaacaatacaagctcagaccccgtttccgtggtgaaaaaagccattgagggcggcgctacgctttttcaatttcgggaaaaggggagcggttctttaacaggggaggaacgtgtcctgttcgcgaagcaggtacaggatgtctgcaggcaggccgggattcctttcatcattaatgatgatgtcgaattggccttgcgccttgaggcggacggagtgcatatcgggcaggatgacgcagacgccgaagaaacgagagcggcaatcggcgatatgatactcggtgtgtcagcacataacgtctccgaggtgaagcgggcggaagaagccggagccgattacgtcggaatgggcccggtctatccgaccgaaacaaaaaaagatgctgaagccgtgcagggcgttacattgattgaagaggtgcggcgtcagggcatcaccattccgattgtaggaatcggcggcattacggctgacaacgcggcgcccgtcattgaagcgggtgcagacggcgtcagcatgatcagcgccatcagccaagccgaagatccaaaagcggcggcgcggaagttttcagaggaaattcagcgctccaaagcagggctgtcccgataggacggccctttttctgtgtgcgcaaaaaggcagtgacggacttggagaatataagccgtatgtcaagaacagggcaatcagcttgcaatatcgaccgaagtgtttgacggctctatcgcttcgctcaaagtgatgcctgaaccaatcattgccggcgccgaaggcttaaaagccctctatgaaacagtgaaaagcgcgcagtgagagatcatttcgaggtcacggaaaaacttgatgcggaattcagcgaatttgaaggtttgatgtcgaaatacaaaacgtgcgatcaatcgtatatgtcttgtgatacattaagtacagatcaaatcagagagataagcacgaagctgacggccctttctgaaaccatgtcgaagattgccgatgtgctttaaaaggagttaagacgcagcatgagcgatgaacaaaacaaggaaaaacagatccacagacgggatgtcctgaagtggggcgccgtcgcgggcgccgccgttgctgtcggagcgagcggcctcggaggactcgcgccgctcttcaaaccggcggccaccgcttcaaagaagaatgatgaaaaacgtgatcgtgatcaaatcgttcctttttacggaaagcaccaagcgggaatcacaacggcgcatcagacgtatgtgtattttgcggcgcttgatgtcatgtcaagcgacaaagccgatgtcatctcccttttcaaacaatggacaagcctgacgcagctgctgacttcaggcgccgtcccgtcgggcgaacagaaaaataaatatatgcctccgcaggataccggggagtcgcaggatctggcaccggcgaatttgaccgttaccttcggcttcggccccgggtttttcgagaaagacgggaaggaccgcttcggactgaaagataaaaaaccgaagcacctcgccgatattccgccgatgcctaacgacaagcttgataagaaacaaggcggcggtgatatcgtcatacaggtctgcgcggataatgaacaaacggcgtttcacgcggtgcgcaacctgatgaaacaggcatcgggggtgtgcgaagtccgctttctcaataaaggtttcttaagcggcgggaaaaacggagaaacaccgcgcaacctcttcggatttaaagacggcaccggcaaccaaagcacaaaggatgaaaacctgatgaattcgatcgtttgggttcaatcaggagagcctgactggatgacgggcggcacgtacatggcgtttaggaaaattaagatgtttttagatatatgggaccgttcatccttgaaggaacaagaggacacgttcgggcgggtgaaaagctcgggcgcgcctttcggacaaaaaaaggaaaccgatcccgtgaagctgaatcaaattcccgccgactcgcatgtcagcgtggcaaaatcaaccggcagacagattctgcgccgggcattttcctatacggacggaattgatccacagacgggctatgttgacgcaggcctgctgtttatctgctttcaaaaagacccggaccgccaatttgtcccgatgctgaaggctttggcggcaaaggatgcgctgaatgaatacacacaaacgatcggctcttccttattcgcctgtcccggcggctgtaaaaaaggagaatatatcgcccaaaggctgctggaatcgtgacaccttccatatggagggtgtttttaaaaaaaacacttgtaactacatatgttacaacttaaaataaaaaggaaaggagacttacaatgacactgcagattaaagtatattctgattatgtatgtccgttttgctttgtcggcaaagcggcgtttgaagaagcaatcaaggacaaggacgtacaggtggaatggatgccgtttgaattgcgtccgagcccctcgccgaaacttgatccggtgaatgatcccgccaagcggcagatgtggaaaaactccattgagccgatggcgcagtcgttaggcgttgaaatcacgttcccccgcgtgtcaccgcatccttacacggatttggcatttgaaggctttcatttcgcaaaggaacatgggaaaggaagcgaataccatacacgcgtttttcaggcgttctttcaggaagagcaaaatatcggtgacgttggcgtgctgacaaagcttgcggaagaagccggacttgacggcgctaccttcaaagaggcgcttgagacaagagcgtacagacacgtacagcgggaagcgctccgccatgcttatgaggaagccggcattacggcagtgccgacgtttatcatcggcgatgagagaatccctggcgcggcgggaaaggaaacctttgaacaaatcattgagcgggaactgaataaacgttaacccgaaaaaagccctctcgatcagcgagagggctttgccatatagtgtttgacaaatgtttgtctgtccgcttcatatgccgcggcgtcaaatgagtcgccgcaaaaatgaaggcaccaagggtctttctggcaggcgacgccgacttgatagccgtgtttttgaaattcaagcgactgtgatgtgtcgtaaaaatgaaagccgcgaaacaaatcctcccgccactccacgtcatattgagccgccattaacaagccgtcaatggcgtcagcgggcgtaaacaggccgtcttcatcgccgtgctcaaagtccagcgggtgataagcattcccccggtattcaatcacttttcccatccgctctccgctttcccaccaaatgccgttcggcggcagggttttgcagccggcgacaccgagaaggccgagctcctgatgagtttgaaagatatgaagcatgtcatgtaggaaatgctgatgaatgataaaggtatcctgatgcagataaattttatatttggaggggtgtctcagcgctttgttgtaggacgaggccatgcttgctgaatcgtatatcggcatgatatcaacggagtatgaaggggggacggtaagctgcatgatatggcttttgcatcgggagtagagcgactcgtcattcacacagacgacaaacagaaatgaatgtgaatccattacatgctcctctcggcctcaatcacatattgataggccgatgcttctgtcataaagtcatgccttatgccaagctgtacgcatacttcgtgcaatgctgcgatggctttgtggtaagaggggtgatcaacgcggatcgcctcaatgcgtttcacctcatagccggcagctttaaataatgaaagtgtctcttcacgggtaaaaaaacgcaggtgggtctgatccattaatccggcgtcactgtaagtccatttgccggctaaaagctccagcaccactgagatgtggccgacattcggtatgcatgcaagcaccgtgccgtctttttttacataaggacgaagctttttcagcacggaccacgggtcgacaagatgctcaagaacgtctccgaacagcatgcagtcgaattgttctgattcgtacggaagaatggcggattcaatgtcgccgcaaagcacgtggctcaatttgctttccgccttttttgcggcttcgggatacgcttcaatgccgtaaaccgttattccgcggtcttcgatcgccgctcctaaattgcctgtgccgcagccgacatcaagcactgtccgccagttttcgtctattttgttcaataaataaggattcaggccttcgtagtagttctgttgtttttcatcataatagggattcgtatccatctgtgtatcacctcataaatgggcatatacacaagatatgcagcggggggatctcatatcaccatgtttggctgttcaattgcggaatgcggacgggaatggttgtccggtatacggtttgttctctgattcccctcttattgcggctgttcctttgaaaactcgggtgcgggcggactgtggcaggtcatatagtaaaaggatccgcctgtaatcttaccgctggcggatggtgtttttcattggtgtttttttcttcaccgctttttcagtatttaagaagcgcctcacatcgtcaatgtgcaaacccatgattctagcctcttgaattaacaattgccaatcttgatctatatctttcattacatgagttttcataagaacctccaattgaaaaattgatttgcccagctacagcagccaatgtataacaaatatcacacatagttggccggtaatcccaaattgaagatgaattcacctacctattccctaagaaaatgactgaaataaccaaaatccttcaagaattcttacgtataataataaacaaataaatactgactggatagtatgcaaataaaaataaatcatatgacctattaatatttaccctcaaagcgtcgactagcatattctttttgcataaaaaataccgcaaaagaatgattcggtgtaagataaagtgaatgatcaaacagctggggtaaaaaatgaaaaaaaacaaatttcaaattaagagagaagaaacatttgaaagttttattgacgcaggccttcatctcctgattgaaagagcttacgattcagtctcaatcgatgacatcagtaaagcggcgggtttcagcaaaggcgcgttttacgttcattttgaaagcaaggaagattttctgaagcatttattagacaggcgtcagattaaaaaaaggatcatcaccggctatctcgatgaattagaaaagcaaacagcgcggccgttgacgctttgtgaagctgcggcaagcgcggccagtctgttgatgcggtttgtaaacagcaagcctgcctggaatgttgtgtcttttgccgttcatatgcctacttacaaagtcgtcagtgaatatgaagcttatatccgtctttataagttatggatagaagaaagcaccatgtacataaattggctcaaatcgagaaatttaatagaagaccatatagataccgagcataccgctaaaatgatgtgcgcgctcatcgacgggatgattaagcaatccaatgtgctgggaaggccggttactttccgcagcatgtttgacgcgctctatgtttttgtcagcggcagaaaatcagggtaacgttcttcttgatttgacaaaaggtttagaaaagtctttcagaaagcgaggaactgccatgcgctacagagaaattatgatgtatatcattatggggatattcacgaccatcgtgaatatcgtcagtttttactttctgacgtcggcatttgagatggattacaaggcggcgaccgtcgctgcttggattctgtccgttctatttgcatatgtcacgaataaactgtatgtatttcagcaaaagaccgcggggatgcggagtctgatgaaagaattgacggcctttttcagcgtgcgggtattgtctctcgccatcgatctcgccatgatgattcttctggtcagtcaatttcatatgaacgaaacgttggcgaaaatcgccgataacgtcattatcgtagtcgtcaactatgcggccagcaagtggattgtcttcagaaaagcgaaagaagagggcgtgtcataacggtttctttccgcgccccgggggaaagtgtaatggtgaaaggggatgcgtatgaagcacacaataaagaaagcgtttgctgatgtattcggggaatcggaggacctgcgcattttctttgcgcccggcagagtgaatctcatcggagagcatacggattataacgggggccacgtctttccttgcgcgctgacgatcggtacatatgcagccgtccgggagagaggggacaggctcgtcagaatgtactctcatcattttaaagatgcgggcataaaggaatgcagtctcgataatatccgttatcaaaaagaggacgggtgggccaactatccgaaaggggtcatggcggaatgtctcggcagcggtttttcccttccgcacggcctcgatattgtgttctggggaaacatcccgaacggcgccgggctgtcatcttcggcttcgattgaacttgttacggcggtcattctcaaggaatgccatgagcttgaggcggatatgctcgacttggtgaagctcgctcagacggcggaacattcctttatcggcgtcagctgcggaataatggatcaattcgccatcggaatgggaaagaaacatcatgcgattctgctgaattgcggtacgctcagctttgaatatacaaaactcgggctgtcggggctgtcgatcgttattgcaaataccaataaaaaacgaacgcttgcagactcaggctataatacgaggctcaaggagtgcggggaagcgctatgtgatcttcagaagcatctttccgttcaatcactgggagagctgaccccttccgcttttgacgctcatgcggagctgattcagaatgaagtgaacagacgccgggcgaaacacgccgtctatgaaaatcaccgcacaatagaggccgccgacatgttcagtaacaatcagcttcatcatatcggtgaattaatgagggattcgcatctctctttacgcgatgactacgaggtgacgagtcatgagctggatacactggctgaagcggcctggcgccacggcggggtgatcggatcaaggatgacgggagccggtttcggcggctgtacggtcagtatcgtcaaggatgatgcggtttcggattttattgaaacggcaggagcccgctatgaggaaaagacagggagaaaagctgacttttacacggcggatgtcggagccggagcgagagaactaaagggggatgacgatggcaattgagcggcacgtggaacgtttaatccggtacggattgcaaaaagagctgatttcatttcttgatattgaatatacgagaaaccgtttgtatgaagctttgcatatcacccatccggaggtttcagaacagaaagaaaatgtatcggcggcatcattgccggacatattggccccgatttatgaatgggcggcagaaacgggccggattgcagccgatacagacacctatcgcgacctgctgagcgcgaagatcatgggctgctttgccccgcagccgtccgagattgtccgtcgttttgaagaaacaaaggcggtgcacggaccggagcaggcgacaaaggcgttttaccgattttcagaggatgtgtattatatccgttcggacagaataaagcggaatgccgggtggacggctgagacggcttacggaaagctggacatcacgatcaacctttcaaaaccggaaaaagatccgaaagcaattgccgctgccaaagagcagcctcaatccgattatccgagatgtgttctttgtaaagaaaatgtcgggtacgaggggagaccggatcacccggcgcgtcaaaaccttcgtgtcattccggtaattctcggcgatgagcagtggtttctgcaattttctccgtatgtgtattaccgggagcattgcatcgttttgaaagaccggcacgaaccgatgaagatcagcaaaaaaacgtttgaccggctgctgtcgttcgtcagccagtatcctcattattttctcggttccaatgctgatctgccgattgtcggcggcagtattttaagccacgaccattttcaggggggcaattatgaattcccgatggcgcgggcggagacagaaagccggtacaggctgcctgactatccgaaaacggtgttgggaattgtgaagtggccgatgtcggtcatccgcctgcaaagcgagagtgcgtctgagctttccggcgcggcggatgccatcctgcgggcgtggcgcggttattccgatgaggcggctgatctcctcgcccattcaggagaaacaccgcacaatacaattacgccgattgcccggcggagaaacggtttattcgaattagatctcgtcctcagaaataaccgcacctctgatgagcatccgctgggaatttttcatccccatcaggaagttcatcacctgaaaaaagaaaatatcggactgattgaggtaatggggcttgcgattctgccgggccgccttgaacaagaaatgaaatacacggctgaagcgctgtgctcaccggacccggaagcggtcttaacggcagacccttctgcggcagcgcataaagattgggcgctcagtgtgctgcataagcggaaggtaacgaaagaaaacgcggaacagattctgaaagaggaaatcggccatgcctttgcgcggatactggagcatgccggcgtctttaaacaaacagaagaaggcagagcggctttccggcggtttatccgccatttgggcgctctaccggaaaaaagccccatcccataagggacgaggctttttttttatcctctgcttctggcgatcaggctgaataagaacaccacgatcgcagctccgatgattgccggaatgatggcaaagccggcaaggtgagggccccatgtgccgagcagtccgtgcccgatccatgcgccgatcagaccggcgatcattgacccgatgattcccccgggcatactgccttttacaaataaacttccgatccagccgataataatagcgacaatcagagatacgataaaacccataaatatcacttcctattttttattatttatgcctatatgtttccttcgttttgtccatattaaacatatgaatgtgttttttataatgaacatatcaaggcgcgttccggtcttttttttcacaatgcattgcgttaaaatggaaaccgtgtgaaaaggtgtgagcaaaggaaaaaatatttcttttgtagaatgtttaacaaaatgaaactttttgttgaccagcgttttttattatggtaaacctttatttggtattattcgttctcactatcttttttctctatatatgctaaatgatctaaaactttttatgtttgatttgcgcaagtggaaaaagttcatgcattttttgacgattttgtgacattaggtcgaaaaaaagatgaactttagaaaaaaataaagctaataagggcagattttgatagcataacaaggtagatagagaaaagattttgagaaagtacatttcagattcactacatcaataggaaggatggtgatcttcttgttcagagcatttaaaccgttacttttattagcgatgttggctgttgttttcgtactgggcggatgcagcgacatttccgttttagatccgaaaggacctgtagcagaccagcagaaagatctgattctcttgtcaatcggatttatgctgttcattgtcggcgtcgttttcgtactatttacaatcattttagtgaaataccgcgaccgcaaaggcaaagacagcggaaattacaagcccgagatgcacggcaacacgttcttagaagtagtctggacagtgatcccaattttaattgttattgcactttctgtgcctaccgtacagacgatatattcgttagaaaaagcgcctgaagcgacaaaggataaagagcctcttgttgtttatgctacttcggtagactggaaatgggtattcagctaccctgagcaggatattgagacggttaactacctgaacattcctgtagaccgtccggttttatttaaaatttcttcagccgattcaatggcatcgctatggattcctcagcttgggggacaaaaatacgcgatggcgggaatgctgatggatcaatacttacaggctgacaaagtgggaacatatgaaggccgcaacgcgaacttcaccggcgaacactttgccgaccagaaattcaacgtaaaagctgttacgcaaaaagactttaacagctgggtgaaaaaagcccaaagcgattctccaaagctgacgaaagagaagtatgacgaactgatgcttccggagaatgtcggtaaattaacgttctcttctacacacttaaaatacgttgaccacggccaagatgccgaatatgcgatggaggcgcgcaaacgccttggctacaaagccgtatcaccgcactctaaaacagatccgtgggaaaatgtaaagaaaaacgaatttaaagtatccgacgataaacaagattgaaattgaacaagaaaggaggaagcccgaatgaaattgagatgggatgaattttttgtaacaggtgacccattaattctgggcgcacaagtttccattgcgctttccactatcgctatcatcgttgtactcacatacttcaaaaagtggaaatggctctggtctgaatggctgacgtctgtagaccataagaaacttggaatcatgtacattatctctgctgttatcatgctgttccgcggcggggtcgacggcttgatgatgcgcgcccagttagcgcttcctaataacagttttttagactcaaaccactataatgagatctttacgactcacggtacgatcatgattatcttcatggcgatgccgtttttaatcggtctgatcaacgttgtcgtacctttgcagatcggtgcgcgcgacgtagcattcccttacttgaacaacctgagtttctggacgttcttcgtaggtgcgatgcttttcaatatttctttcgttatcggaggttctccgaacgcaggctggacgagttacatgccgctggcaagcaacgacatgagtcccgggcctggtgagaacttctacctgctcggtcttcagattgccggtatcggtacgctgatgacgggtatcaactttatggtgacgatcctgaaaatgcgtacgaaaggcatgacgctgatgcgtatgccgatgtttacatggacgacgctgattacaatggttattatcgtattcgccttccctgttttgacagtggcattggcgctgttatcatttgaccgtttgttcggcgctcactttttcacgctggaagccggcggtatgccgatgctttgggctaacttgttctggatttggggacaccctgaagtatatatcgttatcttaccggcattcggtattttctctgaaattatttcagcgtttgcaagaaagcagttattcggttacaaagcgatggtcggctcaattatcgccatttccgtcctgagtttcctagtatggactcaccacttcttcacaatggggaacagtgcgtctgttaactctttcttctcgattacaacgatggcgatttcggttccgaccggggttaaaatctttaactggctctttacgatgtataaaggccggatcagttttacaacaccgatgctgtgggcgctcgcgttcatcccgaacttcgttgtcggcggggtaacaggggttatgcttgcgatggctgcagcggattatcaataccataatacgtacttcctcgtatctcacttccactatgtgctgatcgcgggtacggtatttgcatgtttcgcaggatttattttctggtatccgaaaatgttcggtcacaagctgaacgaaagaatcggaaaatggttcttctggatctttatgatcggatttaatgtatgtttcttccctcaatacttcttggggctgcaaggtatgcctcgccgtatttacacatacggaccgaatgacggatggactgcattgaactttatttcaactgtcggagccttcatgatgggtgtcggattcttaatcctttgctacaacatctactacagcttccgctactctactcgcgagatcagcggagattcatggggcgtgggacgtacgcttgagtgggcgacttcatctgcgattccgccgcattacaactttgcggtgcttcctgaagtgaaatctcaagatgcgtacctgcaattgaaagaagacaaaacggatattcatccggaaagcaagttcaagaaaatccatatgccgcacaactccggaagaccgcttattatgtcagtggcgttcggtattgcaggcttcggacttgtatttgaatggttctggatgggcattgtcggcttgatcggcattctgctttgcatggtgcttcgttcatttgaatatgacaatggctactatatacctgttgaagaaataaaagagacggaaagaaagatttccgaataaaggaggcgtgatttatggaacatgcagaacacggcaattctaacgcgcctatggaatatcaatctgaaaccggcagactcaatattctcgggttttggatctttttaggggcagagattgtgttgttctcaacactatttgcaaccttcttcgttcttcaaagaagaacagcaggaggagtcttaccggctgaattatttgaagtgaagcttgtcatgatcatgacattcctgcttctgatcagcagtttcacctgcgggatcgctgttcatgaaatgcgtcgcggaagtttaaaaggcgtcgtcatttggacgatcattacgcttcttcttggcgcgggcttcgtcggatgtgagcttaacgagttcatccactatgtacatgaaggagcatctctcggtacaagtgctttctggtctggattcttcgtccttctgggaacgcacggaacgcacgtaacgatcggtatcttctggattgccggcatcttactgcaattgaagaaacgcggattaacgccgcagacgtcttcaaaaatctttatctcaagtttatactggcacttcttagacgttgtttggatcttcatctttacaggcgtctatctcatcggattggggggactataatatggcaaacaaatctgctgaacacagccactttccgtggaagcatatcgtaggttttgcgttgtctattattctgaccctgctggccctttgggttgcagtatatacggaattaagcccatcagcaaaactctggatcattttcggattcgcatttatccaagccggtcttcagcttctcatgttcatgcacatgacagaaagcgaaaacggcggaattcaagtcggaaacacgctcttcggatttttcggagcgattgttatcatccttggttccatctggatctttgcggcgcactaccatcacggtgaccatatggatggaaaccctcctggcggtgcgaagcatcattccgaacatcaggaataaaaagaaaccctcttcgtttatgcgaagagggtttttggtgcctttattggcttcttctccggcgcaggcgcgggaggccgtaaatgataaaggcggcgatatgggcaacgatgacgttgacggcaaacaggatgatcatgagtgtgtggccgagaggggataggctgctggttgcgtaaaagtagaagaaaacccacatgagaataattggcggtatggccgaaagagcgacttttttgttatccagccagataaagaggggtgttgcgctcgcgaccagtaaataagcaaaaaacatgtccatcttacatgtctcctttcattttatgggagcgtttccaaaatgaaatacagagaatgaaatgtgtctgttttgtggtcgttttttgaacattttgttacaattattataccatgttttccaatttttgataccgctttttcgagaaatgtattgcaactattgcctcatttttggataggtacaagaaaccggaaaggccaaataccctgtcacatttccggacaatggaatggcgcaggctgtgaacctttgctatggtcaaagaaaatatgcacagcaagggtggtttgaagtggacgtaaggaaagaagatgtcacagcgccggatgtctttgcgcttttgcaggatcatctgaagagcatgaccatgcattctcctccggaaagtatacatgcgctcaatgcggaccggctgcgtcagcctgacgttacgttttggagtgcgagggaaaacggcatcctgctcggctgcggtgccttaaaggagctaaacagccggcacggtgagatcaaatcaatgaaaacctctccgcatcatgtcagaaaaggcgttgccaaccggatcctccgccatatgcttgaagaagcaaggcggcggggctatcatcggatcagcttggaaaccggttctatggaggcttttctccccgccagacgcctgtatgaaaaagccgggtttcaatattgtgatccgtttgcacattataaagaggacccgaacagcttgtttatgacgttaaacataagctgaaaccccttttctgacgagaaggggttttttatcggaaaagtttcatcatgaccgaaacatttccttttctgacacgtcatatgtcgtgtagtccccaaaccgtaaaaaataaaaaggaagcaacctcatcatgttttcttgaacggtgttcatgtataataaacaatagtgacttccgatgaaaatgtaaggcgggatagaatgagtcgatataagaaacagcaaaatccctattatcagggggatttgatttttatatttggtgtgtttttaataattagtgttgcggcgatttatgcggccggacagttcgggcagtacggaagtgatgcctggatgagacagatcgtcttttatgtcatcggagccggtctcatggtcagtatcatgtattttgatttagagcagcttgaaaaactgagtctgtacgtgttaattgccggcgtgctgtcgctgctccttttacgtgtggcgccggaatccatcgcgccgattaaaaacggagcgaagagctggtttaaaatcggcagctttaccctccagccctctgagtttacgaaaataggaattatgatgatggtcgcgtccattatatcgaaggcgggcccgaaggatcaaaggtcacttagggaagatgtgaatctgcttttgaaaattgcggcatggacggttattccgatcgggatgatcgttttgcaggatgccggaacgggtgcgatctgtctgtttatcgttatggtgatggtgtttatgtcgggtgtaaactggaagctgattaccattatcggcggttcggccgcgcttgtgcttggccttttcttagttctcgtgattgaatttccccatgtggcgaattcaatcggcattgcggattatcaaattaaccggattacatcgtggatgtctgactccagtgcggcaacgactcaggcagagagcgataaaagctggcaggtggatcaggccgttatggcgatcggatcgggcggcattaccggaaacggcgttcataatctgaaggtgtacgtacctgagggacagaccgactttatctttgcgattttgggtgaaagttttggatttttaggctgcgccattgcggttgtcatgtttttctttttaatttacagacttgtggtgctgattgaccgcttgcatgcgtttaaccgatttggcgcgtttttttgcgtaggatttactgcacttatcgtgattcacaccttccagaacatcgggatgaatatcggcattatgccggttaccggtattccgctgctgtttgtcagctatggggggagctcggtgctttctacattaatcagcttcgggatcgtatataacgcaagtgtgcagctgacgaaatataaaagctacctgttcaattcttaatgtgagacggctcgtttttcgggctgtctttttttgtttagagcatttcgcttttgacatgattccctttcggatatgatatagagagaaggaggcttttatatgaacaataccattgaaaccatacttaatcatcggtcgatccgatcatttactgacgagcttctgacagcagaagagatagatacattagtgaaaagcgcccaggcggcgtcaacgtccagttacgtgcaggcttactccatcatcggcgtaaccgataaggagaaaaagcggaagctggcggcactggccggaaaccagccttacgtcgaaaataacgggcacttgtttgtgttttgcgctgatttgtaccgccataaaaaacttgctgaggaaaaaggcgaaaacattaccgagcttcttgagaatacggaaatgtttatggtcagcgtcattgatgccgcacttgccgcacaaaacgtaagtgttgccgcggaatcaatgggacttggcatttgttatatcggaggcattcgaaatgaacttgatcaggtgacggaagtgcttggaacgcctgaccatgtgctgccgctgttcggcttggtagtcggtcatcccgctcatccgtccggtcaaaagccgcgcctgccgaaacaagccgtatatcatgaaaacacgtacgatacgaatgaagaacacttccgcagttatatgaaggaatatgatgaaaccatttccgcttattatgataaacggacaaacggcaagcgggttgaaacgtggtctgatcaaatcctgcagttcatgaaacaaaaaccgagaacctatttaaatcaatatgtaaaagataaaggttttcaaaagaattaagaaaaaacctctcctgacgggactgacccccgtttttgagacagggatcaaaacacctttaagcagccagctgtcggtatgtgaccggcggctggttgtttagtttcgtttgaatacgaatgttgttataatagtgtatataggtttcgacagtttgttctacgatggtcgtcgtagtgctttccaacctgtcgaggtagaacgtttcagactttagtgaggaatgaaacgattcgatggaggcattatcagcgggcgtccctttgcgggacatgctcatggtaatgccttttgttttaacagctttctgatactcgtaagatgtatacacagaaccttggtcactatgtaacacgcagttctcaggcagtgcgggcagctgatcaagtgtgtgtaagacaaagtctgtgtcctgtctatcgccaatcgtaaaagcaatcacttctccattgtataaatccaatatactggaaagatacaattgtttctgcccataaggcaaatatgtgatatccgttactagcttttccagagggcgatcagactgaaagttccgatccaatatattctcggccacggcatatggctgcccattcttcttgcgctttttcaccttaacccggcattgccactgattcttctgcataatgcgctgaaccgttttatgattcatacgcattcccttttttaatatggctgtgattttccgatagccatatcgatacttgtgttctcggcacaacgtgccgatttgtttttccaaatggcgcttgggatgatccttcatcagattcttcttccaacgataataagacgctcgagagatacctaaatgaatacagatatcctgtacggtcattgtgctgtgcaatatttctacaagttcgactgacgtttcgctatcaacttcctttccaattcgttgtacttttttaacacttcattctgttgtctcagataacgattttctgcctgcagtttctctaattcggaagaatactctggaccttttccgtaagtgtattgctttccaacaggctgttcgaatcgatgtgtatcaccagccttataccatctaacccatgtctgaacctgtgtcttattcttaatattcaactcctgcatgatctctttcataggtacgcctgccaatctcatttctacagccttctgtttcgcttcaaccggataactcactcttgtccccatagaaaaaacacctccaagtctaatttcggataacaatcatccgtattcaaacttgaaggtgtttttatttgtctcatcttatggggtcagtcccaccgggagaggtttttttatgtttcacgtgtaacatatttcgacaaaatggaacaaggtatataaatgtttatcatcagggatgcttataagcatacagaaagaaaaaacggcttagcagtggtacgatgttgatgaggtgacagtgatgatttcattaagcatattagatcaatctcctgtatcagaagggagttccgcggaaagcgcgctgcgggatacagtaagactggcgcaggaggcggaaaagcttggatataagaggttttgggtgtcagagcatcatttttcagagcggttggcgggttcaagccctgaagtgctgatcagccatattgcggcgaaaacgaatgagattcgtgtaggctcgggcggtgtcatgcttccgcattacagcgcatataaggtggcggagaatttccgcgtgcttgaagggttgacgccgggcagaatcgatctcggattagggagagcgccgggcggaatgccgatcgcatcatgggcgctgaatgacggcgggaagcgtaatgctgatcaatatccgcagcagcttcgtgagctggcgatgtatttgcatgatacagctgatgacaatcaccgttttccgaatctgaccgcatcaccccttattaagacggcgccggaagtctggcttctcggttcttcgggggaaagcgcgcttctgagcgcagaaatgggagcaggctatatgtttgcccattttattaatggagaaggcggagaaagcacgacagcacaatataagcgcagatttaaaccttccgcattaggaaaagaaccaaaaacggccgtggctgtgtttgtgctgtgcgcggacacggaggagaaagcggaggaactcgcggccgtcatggattatacgctgcttgcgggtgaacaggggattccgcttcacggcgtaccgtcttacgaaaccgtccgcggaaatacgtatacaccgtatgaacaaagacgaattgccgataatcggaatcgaatgatcatcggaacgaagccgcaagtgaaagaacagattctggctctcagtaaagcatacggaacggaagaagtgatggctgtaaccattactcatcattttgaagataaacttcagtcataccggctgcttcgtgaagcttttgccgaatgatcagaaagaaaccctgctgatgctccagcagggttgttcggttattcaatgataaaaggtttttcagtcagcacctggcttgatttccctttgttcgcggcataggccagcatataatattctcctgccggcagtgcgctgtcaccattgactttgccgttccagtcgaaatattgatagcctttatcctgctttttgtagatgccggcttggccgacaaagtcaagattgctgtcatatacaaggaaggcaagctcttcggctcccgccggaagataggtttcaatttggtaggttccctgcgttgtgccgtcctgcacgtcgattgacgtcacgcgcggatagtccggctcttttacaatcagcagcgtcggcacttttgcaactgtttttccgccttctcgcactgtgacggttccctcataggtgcctgcctttacttttttggcattgacctttactttcgcattgacctttccggtttgatgagcggggatcacgacccggtctgtgcccgaaacggtaatgcccctgccgttgaaagagtactcgagctgatatgattttctgatggacgattgattttcaatcgtaaaggtttcttttttcgtttcattgcctttgtctttcataaacgttccgtaagaataacttcccggggcgacaagggagtctgctttgatcgccttcatgattctgatgcttccggcaccttgcgcattatgcgggtatacgtcaccgtccgcgtccgttaaggtttccgccgtgttcatgagagcggcttttatttgttccgggctccatttcggtttggcctgcttgatgacggcagctgcgccggctacatgcggggaagccatgctcgttccctgcttcgatccgtagccgtacgggtcggccggatcatgggtcggaatggtgctgacgacgtttacgccgggggcggagacgtcaggtttaatcatccacgtgtccataaccggaccgcgtgacgaaaagtctgccatttgttcagtgagcgatttagccacggataaattgaaagtcgcttttgtgccgcccgcttttaattggctgacgagtttttcgccgtcttctgatgaaagcttaatcgtcggcacggacatgcccggtacgtttgcttcaatttctcccggggcattgttatacacaaccataccgatcgcgcccgcttttttggcgttgtctgctttatccacaaaggcgatgctgccccgtttgacgacagcgacttttcccttcagatctttgccttcaaaatccttttgctcgccgatacccgcctctatgagctctgtttcttttttattcagtgcttttatgtcatcttctttgttgtagcccattactttcgctgaggaataggaaccgaaggacacggcgtactcgttcagcggcagctgggtcgctccgacggagatggcttctctggacgttcccggagagccgacggtccaattgttcggcccgctgtttccgtttgatgtaacggccgtgacgccttctgacatcgcccagtcaagcgccgtgcttgtcgcccagtctgggttattcacagaattgccgagagaaaggttcatgacatccgctccgtcctgtacggcgcgttcgatgccggcgatgacgttctccgttgttccgcttccgcccggaccgagcacacggtaggcaaggagtgtagcatccggcgcgacgcctttgatcgttccgtttgccgctaccgtgcccgcgacatgggttccgtggtcagtcgacgcgcctctcggatcaccggacgccgtttcttcaggatcgtaatcgttatccacaaaatcgtatcctttatattgtccgaaatttttctttaagtcagggtgtttatattcgacaccggtgtcaataatggcaaccttgacgcctttacccgtatagccgagcttccacgcgtcatttgcccctatataaggcgcgctgtcatccatctgcggagacacggcatccttagatagggtgatgtctttatctttgagctgatcggtatgataggtgacattcggataaaccgctttgacatcctgatcactcagcagtttggggatttcatttgccgggagtttcatggagaagccggaaaacacttgctcatattccctgttaatttttccgtgtttaatggttttgagcgctttctttttcacttttgcgcgttcgcttttcagcctgctttttgtctgtgctttgccgagttcctttgcttccgccagtgacttttccttcagctccacgatgactgtcgtttgtttgccggtggtcatatcaatgtcaccgaacacctcagccttctcaagatcaggagtttgcggttttgaagccggcgcagcctgtgaacttgtggataaggtaaaggataagacaaaagccggaagcagataacggatgattccttttttcaatcgtgtttcccccttttttctttatctaaattagaaatctagtatatatttcttgaaaattcaaaataatccttgtgacatatgactcatttatggaaattggtctgtgaataaggagggagttatacacagaatcctgtgtataactgaataaatttgtgtatatatattgttgggaacgagtgttcctatacaaaatatagatcgagtttgtggatatgtggatatgccctgtgtttaagctgtgcttaaccaagggataaggtgtgtataactttttttatcggcttttccatttttcaggtcatttccatcagctttcaacaaaacttctgaaaactagtttgttttttcactcatattgtgacaaacaattcgcccggccgcgtctatcatagagtcatagggttgctagacccgctagtttttagcggagaaggatcggccgccttttccgttaaagcggagagaaaaacaggcctgcgaacaagctgtctgtcaaaaagaagcggagggatgatttgcaatgaaacgtttgctagtatctttacgggtgtggatggtctttctgatgaactggatggcgccgggtaacggaagatatccattagccgccgtgtacggaaaccaagcggcttatcataagaaagcgaagcggacggctggggctttttcgtttgtgagccgtgtccgatcggcggatttgaccgatgaaacgaaatcggcccgcggcaggctggataaaaaccgatggatgcctgtccgcaaagaattgccgaaacgggagcgcgcgggtccggcacctttacatcatatgaaaaagagggtacaatcccactaaacatatgaacgggagcgaacctcttgagaatagacaaagtattaaataacaatgcggcgttaataaaagaagacggacgggaaaagatcgtaatgggtcccggaatcgcttttcaaaagagaaaaaatgatgtgattcaaaaacataaaattgaaaaaatatttgtcgtgcacgacgaaaatgaaaagttcaaacaagtgttagaaacgcttcccgaagagcatatagaggcggctgaagatatcatcagccatgcggagggagagcttgcggcacctttgagcgatcacatccacattgcgctggcggaccatttatcctttgcgatcgaaaggattcaaaacggccttcaggtgcataaccgattgcttcatgaaattaaggcgctttataaaaaagaatatgagatcggccgctgggcggttgaacacgtgaaacaaaccctcggtatatcattgcctgatgatgaggcggggtatatcgcgcttcatatccacactgccaaggcggatgccaaaagcatgtattcggcgatgaagcatacaaccatgatcaaagaaatgatcgaaaagatcgaatcctttttcgaacagaaggtggatgaagacagtatttcctatcagcgcctcgtcacgcacttacggtatgcggtcagccggttggactcaaatgaagcactccattccatggacgaggagatgctttatttcatccaaaaaaagtatccgtttgcttatcggtgtgcgcttgaactggcggcgtttttaaaaactgaatatgatttggagctgccggaatccgaggccggctatatcacgctgcatgtccagcgtctgcaaaaaaacccggaataacgcgtctgtttcgagaaacagactttttttttgaaaacatattgacgaaagcgctatcatgaaatagaatgaaagcgcattaaaaaaactgaatccggcgggattgtgactggtaatgcaggcaagacctaaaatttgcgtacatgaaaaagggatcatgctgacctttttcgttggcgaattttaggtcttttttgattttagaaagggggatacatcatgaattatcaagaaacggcaaaacagcttatcaaacatatcggaggggaatcaaatgtcatcagcgcgacacattgcgcgacgcggctcaggctcgtcattcaagatgaacagaagatcagccaggccggcattgaagaaatagaaggcgtaaaaggggctttcagcagctcggggcaatatcagattatattcggcaccggcctcgtgaataaagtgtatgacgctttttcaaaagaagccgatttggggcgggaagatcgtgagacacatcaggacgcagcgaaaaaaaagctgaatccggccgcaagatttgcgaagacactgtctaacatattcgttcccatcattccggctatcgtggcaagcggacttttaatggggctgcttggcatgatgaaggcttttcactgggtgtctgaacaatcatcgctgtttaagcttttagacatgttttcaagcgcggcgtttatcttcctgcccgtattcatcgggttcagcgcggcgaaggaatttggcggtaatgcctatctcggtgccgtgctcgggggaattatgatccatccggcgcttttgaatccgtgggggcttgcggatgcatcgcctgattttatgcagctcttcggcttcgacattgcgctgctcggctaccaagggacggtcatccccgtactgttagccgtttacattatgagcaaagtggaaaagggcacgagaaaaattgtgcctcacgcattcgatttattggtcacgccgtttgtcacggtgattgtcacaggatttatcacctttatcgcaatcggtccgcttggcagggcgatcggatcaggcattaccgtctcgctgacatatgtgtatgatcatgcgggcattgttgccggactgcttttcggcggtctttatccgcttattgtgcttaccggtgtgcatcacagctttcatgcgattgaggccggcctcatcgctgatttgggcagaaactatatccttcctatctggtcgatggcgaatgtcgctcagggcgcggcgggactggctgtatttttcctgacgaaaaaagcgaaaatgaaagaaatcgctctgccggccgcattttccgcttttctcggtgtaaccgaaccagtcattttcggtgtgaacctaagataccgcaagccgtttatcgcgggaatgatcggcggagcgctgggcggagcctatgtcgtggtgaccggtgtcgccgccaatgcctacggtctgaccggaattccgatgattgccatcacggctccgctcggtttaggaaatcttataaactatctgatcggaataggcatcgcctctgtctcggcgtttattgccgcttacattatgggagctaaagaaaaggaggccgtcaaatgaggacaccggatcaagagctgcgcctgcaggctgaggaagcgaaaaagaagcggggagaaacagccgcgtcagatccataccgccagaactatcatattatgccgccggtcgggcttttaaatgatccgaacggcgtgatccaatggaacggcgtatatcacttgttttttcaatggcagccatttcatacggggcacggcgcgaaattttgggcgcatgtgacgacgaaggatttcgttgagtggaaagaggaagaaatcgcgcttgcaccgggtgagtggtatgacaaaaacggctgctattccggaagcgccatcgaaaaagacgggcggctctgcctgatgtacacaggcaatgtccgtgacggagaaggcaatcgggaaacgtatcaatgcctcgccgtatccgaagacgggatcgtatttgaaaaaaaaggagttgtcgcgcgtctcccggaaggctataccgctcatttccgtgatccgaaggtttggaagaaagacggagcgtattacatggtgcttggcgcgcagacagaaaaactcaccggaagcgctgtgttgttcacatcagagaacttgacggattggacgtttctcggtgcgattgcgggggcggactccggcggtctcgggtcattcggttatatgtgggaatgtcccgacctgttttcccttgacggaaccgacgtgctgctcgtatgtccgcaggggcttgaagccgacgggatagaatatcataacagccaccaggcgggctatttcctcggcaggctgcatacagagccgccagaatttaagcacggtgaatttacggagcttgacagaggatttgacttttacgcggcgcagacgctggaagatgataagggacggagaattctgttcgcgtggatgggcgttccggatcagcatgaggacaaacatccgacacatgcgtatcactggattcactgcttaacgatgccgagacagctgtcactgtccaacggcagaatcatacagcgcccgctttcggaaatgaaatcacgccgcacggatgaacaaaagcaccgtcttcaattgaattgctcgtctgtaagcctcccggtgaaagatgcgtcccgggctgaagtgctgctggaggacatcacttgcgaatccggttttgaaatctcaattcggggcgcggcccggtttatatttcatcaggaagaggggctggctgtgctggagcgcaccgctttcagcggagaagaaaaagaaaagagaagctgctccatcagcgaggtgcattccgtgcagctctttctggatgcatcctcgattgaattgtttttgaatgatggagaagaggtattcagcgccagatattttcctttcccgggaaatgatgacgtaaccgtcacttcggcaggaaaaacggaaataaatggctcgatttggacacttttgtagaaaatcgttcttttttcttatgtgaaacctatgccatctgtgctattcttcaaacgaaagcctatgattccaggaataaaaggagttgttttctcagttttgaaaaatcagaagatgacgccgaaatgtttacttgtcaaagccgcagagcaagtggaagataagcgggaagaatataaagaagtattgcttcagctgaagcgcatgctcaagagagctgagccgcacaatgaatggagtgatcggctgatgcatacatatgaacagatgaaggaatatgcgctgtttgtgcagtctattgagatgtttttgcggtcatccgcgaaaaaaatgaaataatccccctcgggtaatgagggggatatttattttattttccgctaagacgcatcgccgaatgtttagtcggtccgatgtattggttcagcgggaaggattctttgattgccgcggtgataaattcttttgccgcatagatggcttccttcacttcagcgcctttggccagttctgccgtcacggcggcggagaatgtgcatccggctccgtgcgtgtaaggtgtatcaatcatttcgctttctaatacttccgcggtttctccgtcatacagcacgtcgatcgctttttcatgtttcaatttgcctccgcctgtaatcaatacatatttcgcgccgagttcgtgaattttcttggccgcttctttcatgtcttccaccgtttttaattcatccataccgctcagctggcttgcttcaaacaggtttggcgtgatgacggttgccagagacgccaattgggtgcgaagcgcttcggcatgctccggatacagcacttcgttcgctcctttgcagaccatgacaggatcgataacgacattcttcagctgtttttctttaatcgttttcgccgcaagctctatgatctccacggtagggagcattcccgttttcatggcgtctacgccgattccgtcaacaatcgtcgccagctgtgcgcgaatcgtatcggcatcgatcgggaatacttgatgatcccagctgttctccgggtccatcgctacgatcacggtcaaagccgtcattccgtatacgtttttttcttgaaatgtttttaaatcggcctgaattcccgcgccgccgctggaatcagaaccggcaatagtaagtgctttgtgcattgacatatcaatggcctccatcagtgttttatatctcattatagttagattttcttccgatcacaatacggaaggcttggaggaatgatttgacagccgcgggggatgtgcgtacaatacctacataagattactaggtaagggtgagaaaataaatgctcaacagggagcttgtaaagggaagcacggtcattctggtgctgacgctgctgaatgaacggcccatgtacgggtatgaacttgtgaaagaaatggagaaaagaagcgggaatgaactgcaaatgaaggaaggcacgctgtacccatcgcttcataagcttgaacgccaaagctatatttcttcttactgggaaaagcagaccaaagggccggaccgaaaatattaccggatcaccgatgaaggaaaaaacattctagccgaacggacgaaggaatggaatctgttctctgctctgatggaccggatgctgaagcggggcgggcagaatggataaagacctttatgtgcaggaaatcagaaaagggctggaaggcaaggccggaagccgtgaattattaaaagaaatcgaaagccatattcatcatgccatttgtgatcatctggaaaaaggcaaaaccgaaagcgaagcgatggagcttattctgcgggaagtggggactccgtctgagattatctctgcttttcaaaaagcttcggcggtgcccgcgcggacttttatgctcttttatctgttctgcaactgcggtctttttgtgatgggggcgatgattacgatgatgcacgcgtggaggattcatcccgctgttgacgcgctgtggaaagggatttccgtgtcagtatggctgattatgatcggttatgtgctgtattggttccaaatcggctatcaagctggcaaagagttcggggctggcggcaaaaagcttgctgagcggacggtatgggcttcaattgtgccgaatctatgttttatgtttgtcttcttgttcaatctggttccggctgggctgtttccttcggcggtcacaccgagttttgcggcagtatgcgccgttgtgacggtatgttttccgttttgcggaaaaataggtttttacgcaggcaggcagagacttgcctgatctttttcactatatacatagggaatctatataggggtgttaaaatgagattaggttcgtggatgtacggcgcgtgcgcccaaatagccgtaaccgtatttaccgtctgcagcttggttcttgcattgcccgttgtgagtctttttattatggttctgaatgggatgcaagacgctgtttttgttgttttcagtattttgcttcttctattattttatgcgctgggatggatttgggccgtttcgtttgcgcgtgagtggaaggtgaaacttttcgagctgcagatcagttcgctcattccgctggcgggtatattatacttgtacattgacagcggggtgagtataccggaactgattcatgattggggtgaggatggatgtgcgcttgtcccgccggcttttgtctgcttgtgcacaagctatgcgatggtgttggtgcctgtttatcaatcaaaactttggaacgccatggaggcgggcagacttaatgccaaggcggtatgcactgtttggggagaccttctgatcattctcgttttgctggcgggcatgacctggatttgtttctgaatgggccgaaatcaaaaatcccccctgatctctccgccgctttatgttttaatagaacatgagaaaaagcagaaggagcggatcatgaatatatcaattgtcatagtcacgtataatcggattccggctttgtgtgagctgctggagtcgatttccatgcagaccataaagccttatgaagtgatcattgtaaatgatgccggggaatcggtcgaacaagcgaagcagctgtacagcgatctgccgattcagattattgatttagaacagaatgccggacatgtggaagctcggaacgcaggtgtgaaaaaagcgtcgggtgattgtatcatgctgtgcgatgatgatgatttcattacgccgggccatttggaaagaatggcggctgcacttgctgatgcggattttgtccattctgacgcggaaattgtgtcatttgaagaacggggcggcacgagatacccggtgtcacgaaagccgttcgcctatacggcggattatgcggatatgcgggtattttccacgtacgttccgtcaggcagcatgtacaggcgttctctgcatgacacgttggggtattttgatccggatgtccataattattgggactgggacttttatttgcgcgccgcgaaacagcaccgtgtgaagcgtgttccttgcgcgagcgtcatatatgcgttttttgagggaggcggcaatcagtccgcggatctcggcggcaaaaggaagcggtacttagaccggttaagcgaaaagcacgggcttggagaactcccgacgaaaaactttgcggttcttcttgaagagccggacatgaagaggcgggaggcgccgactgacattgtgtgggacggaaagcccgtccattcaagactgcacagttcataagggggacggacagtttgaaacagcttttaaaagacagctggtggaatcagctgaaagatgaatttgacaaaccgtattatcaagagctgagagaaatgctgaaacaagaatacagcagccaaacgatttatcctgacagccatgatatttttaacgccttgcattatacgccctatgaggatgtaaaagcggtcattctcggacaggatccatatcacgggccaggacaggcgcacgggcttagtttttccgttcagcccggggtcaggcagccgccgtctttgaaaaatattttcatagagcttcaggacgatatcggctgctccgtaccgaaccatggatcgctcgtcagctgggcgaagcagggagtgcttttgttaaacacagtgcttacggttcgccgcggtcaggccaattcccacaaaggcaagggatgggagcggctcactgaccgcatcattgatgtggtgaatgaaagagagaagccgattgtctttatcctatgggggcgtcacgcgcagatgaaaaaagagcgcattgacacatcgaaacacattattattgaatcgactcatccgagcccgttttcggcaaggaacggttttttcgggagcagaccgttttcccgtacaaacgccgcccttgaaaaaatgggggagcagccgatcgactggtgcatccccgacctgccgcaataaacggttttttgaggcgcttccgcccggcggtaagcgccttttttggcgttcagggcggtatgccgtcagaaaaaataacaaactcaattctgcgattcgctcagaaatttgataaaatgcaggaagaagacaaattactgctggaggatttactcatgaacatacatatctctgctttgattcagaagatggaagaagaactgaggcaggcgaaaacggcgacccgcaccgaggaggtcaaaatgcacgcggctgccatccgctctctgtgtgatgtcgtgctcggcactcagacgcacaccgctccggcgccagtgcagaatccgattccgaaagcggcgccgaaaccttccgcgtctccttcgacagacccgctgctgcttgaaaaaatgatgggcagcgccgggctgaaccaatatcagaaaaaagcgaaagacgaacgtgaggaagacggaaacggggattccattttcgatttttaacaggagaggttgattgacttgaaactgatactcgggggtttgcaatggacggcatttatgattgcggctgcgattgtagttcctgtcgccatcgcacaatcatttcacttgaaccatgccgattctgccgcattgattcagagcacattttttgtgcttggcgtcgccgcggtcatccaatgtctccagggacatcgtctgccgattaatgaaagcccggcaggcttatggtggggcgtatacacgatttacggcggactgactggcacggtgttcgcgacattcggcgagacgctgcgggcgctgcagggggcgctgttattaagcgctgtctttttctttttgttcagcctttttaaagtgattgaacggctggccgtgctgtttacgccggttgtgaccggtgtgtatctgctgctgttggtcatgcagctgagtcagccgattgtgaaaggccttttgggcatcggctatttaaaaaacagcgtcgacggccttgtattcgggctcgccatggttgtgacggcggcgatgttcatcatgtcccgatcgaatgttacgttcttaagacagtatgcgattctcctttcgcttgccggcggatggatcttattcgccgtcttcggcgctgccaaaccgattcaaataccggaccgcgtgattcagctgccggctctttttccgtttggaaaacccgtgtttgacagcggcctgatcattacgtcacttttcattaccgtgcttttgattgtcaatatgctcgcgagcatccgggttgtagaagcggcggtgaaaaaattcggcggcaccgtcgggaaacggcgtgagcgtccggctgggtttgcggcttcgatcagccaccttttgagcggactgtcagggggcattgcgcctgtgccgatttcaggggcggccggttttattgagacgacgaagcttccttcgaaaaagccgtttcttttgggaagtgtatttgtcgtgatcatcagtatgatcccgctatttatgaatgcgtttgcgagtctgccctcaccggtcggctttgcggtaaacttcgtcgttttctccacgatggccggtctcgcctttacggagtttgactcttatgagaaagcggagcaaaaacgaatccgctccattatcggtctggcgctcctgacgggggtcggcgtaatgtttgtgccggagagcgcgttatcggggatgcatccgatcctgatttcgctcttaagcaacggtcttgtgctcgggacgctgctggcgatagcgattgaccgaatccagcttatcaaaaagaaaaaatccgacaatctcgtgtcatcggacggcggacgttgaattttgccgatgttgggttatgattgaattggaaactttaacgaaaaggcgggagaaaaatagatgaaagtgtttattattcttggtgcgattaacgctttattggccgtggcgctgggcgctttcggcgcgcatgggcttgaagggaaaatccccgataaatatttacaggtgtggcacacaggcgtgcaatatcatatgtatcacgcgctcggtcttctggctgtcgcgtttttgaccgaaaagctttctggcgcaggcagtgtttctgttgcgggttggctgatgtttgcgggcatcgttctgttttcaggaagcctgtacgtattgagcgtgacgcagatttccattctcggcgcgattacaccgctcggcggcgtggcgtttatcatctcttggattatgattatcgtcgcggccgtcaaatatttataaagaaaaaaagccaatcctctgtcaaatgagcgattggctttttgatttatctcggagaataagaagacatggagtacggataagtataagcgatttcctcatcaaacgtgatgtaatcaaggtaaatggtcagaagcagatagcgggtgcccgttttcggatcgctgatgatgatatggtcacgtcccgccgcctgaatcacaccgcggaaaatctttgaattccattctttgctgttttcaaatgtcatataaatcgtcgctgttttgccccggttcaaccgcagaatattttcaatgtatgactcttcaatcggcagcatgccgggaacgttttgtgacgatgatggacctgacggaatctgaaagctgccgccgccctgctgctgcggctggccggggaaccccccgccgaagctctgctggccttgctgcatcggcattgtcatttgctgctgcatcggcatcatttgtgatccttggccctgaggctgcggataaggattaggcccgagctgcggctggtatccttgcatatccattcccattcccatccccatcccctgcatttgctgatattgattctttttcggtttcatattgttcctcctttgatgaaaacctcttgatgctgaaacctcctgacaagtatcagacagccgacagagcggctgctgtttttatctattccaccatatgagcccaaagaaagatttatgcgaaaaaagaaaatacgctccaatgagtccggacatcagagccggctttttttgtgcgcgcaatgctgacttttcacataatagtctgtattcctagcgcatcttccgcataaggaacatatgatagcggtagtttcaggtgcgaaaagggggtgacgagttgcctaaagtgtcagtgatcatgacgagctataacaaaagtgactatgtggcccgctctattaaaagtattctgtctcaaacgtttacggactttgagctgttcattatggatgacaactcaaatgaagcgacattggcggaaatacgtccttttctcacggatgaccgcgtccggttttatcaaagcgatgtatcgggcgtcaaagaaagaacggaaaaaacacgctacgccgccttgattaatcaggcaatagaaatggcggagggcgagtacgtgacgtatgcgaccgacgacaacacgtatgtgccggaacggcttgagaaaatggtgaaagagcttgatgaagacccggaaaaagccgtcgtgtattcaagttccaaaacctatcatctgaatcagcggaaagagacggtgaaggagacggccaggcccgccgaacggatcgtgtggaacgcgccgtgcgccattgaccattgttcggtcatgcaccggttttccgtgctggaacaggttaaatcggcattcggttcctattgggatgaaagcccggcgttttaccggatcggtgacgcccgtttcttctggagagtgaatcatttttatccgttttacccgatttctgaggagcttgatatcaattatattaccgatcaatccatccattatcagcttttcgcggcggagaaaaacgagtttgtgaacagccttccgcagcagaccacgtgccgggagctgagggaatcattaaaaaagcttggaaaggggtgagggcttgtcggcatacttagcgaactattgggtgctgtaccggcagtatattgacctttttcagtcacttcgctacaaagacatcccgctcgcattgatcagtaatttttatcaatatatcagtccggcgcttcgggagagcatggagcagaacccagagcttttcggtccggctgatcagcatattcctgaagccggtatacagccatattatgatcaaaaaaggcaaaacattaagaaaacagatgagaaaccggtaaacggaaaagtcattctgcatttcgatcatcttcggttcaccgagggaaactaccggcagtttgacccggcaaaaacagcggtactggccagatggagtctgcctgaccattacgggctgcccgttatctgcaaattggagctgacgggaatggggcaaaaagggaaccccgtcccttatattgaaaaagcacattccattttgaaagagcttcacagccatcccgctttcggaaacagagaatttcaggaacgtttgtataaagacattccattatttattgaagcgattgacgccattgatattttgtttacggccgaaaagatttccgccgttgtagtcggcacgacggaggatatttacagccgtgtgctggcgctgatgtccgcgaaaaaaaacgccgtcagcatctgtcttcagcacggagcgctcatgggagatgaagcgtttctgcccgtgtttacggactatcaggccgtattcggggcttatgaagcggagtggtataaagcaaaaggctgcagggatgaacaaatcatcatcacggggcatccccgtttcgacgagattttctcaagagagccgatagatcaggacacgttttaccgcaaactttcttttctcccgtcacagcggacggtgctgatcgccacgcagccgttttctgatgaattttatacgggcgtgcttgaagagcttgccggccaaaagaacatgcagctcattattaaaccgcatccatgggaaatcggcaaaaacaagctggatgcttacaatcaggtgctgcggaaatataaagcaggcaaaatcatcaaaaaagagatggagctgtatgatattctcccgtatgttgacgctgcggtgacacagacatcaacggtcggtcttgaagcgatgctgtttcaaaagcccgtgctgatcggaaaatcagcgggaacccgcagatacccttattatcactcacttggagaatttgtctttgaggacccgcaggcacttgctcaggaattgatccggatatgcgaaagccccgcagaatatcaaaaagcggaacaggcgcgccgtgcttttgtcgccgcgaactacccggttcaggattcgcttgccgctttatgccaagtgcttcaggaaaaaaccggagtcagcttcagacgggttgacccttcataaaaaagataggagcgcaaagaaaatggtgcaaaaaagatcagcttttcttccctattcattgcccatgatcgggaaggacgaaattcaggaggttattgatacgcttgaatcgggctggctttcaaagggaccgaaagtagaggcgtttgaaaaagcttttgccgcctggacgggggcaaagcacgcgatcgcgctgaactcatgtaccgccgctttgtttttggccctgaaagcgaaagggatcggtcccggcgacgaggtcatcacgtctgccgtgacgttcagttcaacggccaatacaatcgtgcacacaggcgccgttccggtgtttgttgacatcgatccgctttcgctgaatgcggaccctaaaaaaattgaggcggccgtcaccccgcggacaaaagcgattgtacccgttcatttcgccggccagtcgtgtgatatggatcagattctggccattgccgaaaagcatcagttatttgtcttagaggatgccgcacatgccgtgtataccacgtataaacagaaaatgatcggatcaatcggcgatgcgacggcattcagcttctacgcgacaaaaaacctggcaaccggtgaaggcggcatgctgacgacggacgatgacgggctcgccgatcagatcagggtgctcagccttcacggcatgagcaaaggcgcgtggaaccgctattcttcaaacggaagctggtactacgaggtcgaaacgcccggctataaaatgaatatgtttgatcttcaggcagcgcttgggcttcatcagctgaaacggattgacagcatgcagcaaagaagagccgacattgcgagccgctaccaggacgccttcagacacatgaaagggctgaccatcccgcatgtcagtgatgacgggcggcatgcatggcatctgtatgttcttcaaatagaggagcaggaggccggggtcagccggaacgatctgatttccgctttaaaagaccaatataatatcggtacaagtgttcattttattccggttccgttccatccgtattatcaaaaaacgtacgggtataaggagactgactttccggccgctgcagcgtattatcaccgcaccgtgtcactccctctttatccgtcaatgacagatgacgacgttgaatacgtcattgcagccgttacggatatcgtcaaaggggctgattaggtgtacagactgagggaaaatcttgcgcaggacatgattcataccttcctgcatcagaagggcattcagacggaagcctatgaatcgtcgctctgtttattggaagaaaacagccttcaaggcgtgattttatatgaaaactcttcgtgggaaagtcaattgttccgaaaaaatatcatcaatgtgaagcttgcagccgcaaacagcgccggacagctcaaaaggctgtttcaggaattttacgcggcaaggcgggcggacggcactgattttatatttattaaaataccggctgaagatatcggcgcgatgcaggtcgttcagcagcttccgaacgcttattttgtagggagtctgctcaagctcgtcagtccggtgcgtgtatataacagcacaccgccgtttgagattacagaagccggacccggcgacacggaagcgatcagccggctggcccgcgacgcctttacaaaaagcaggtattaccaagatccccgcctcagctatgaaagtgcaaaccgcctgtttgaagagtgggcgcggaataacgcggaaggcagagcttcgttacaattcgccgccacatataagggagagaccgtgggctttattcaggggctgtctaaaggcgatgaattcgtccttgatctgatggcggtaaagccgggctttgaagggaaaggagcgggattccatttagcggcgcacattattgaacaatcattgcgctttcagcataagactgtatcagcgggaacgcagctccacaatgtaagagccatccgcctgtatgaaagaatgggatttaaagcggatgcgtcctattactactatcatgtgtggcccgggaaggaggcggactgatggcatcatgccaaatcggaacgaagtcaatcggcgaaggttcgcccgtattcatcatcgccgaagctggaattaatcatgacggaaaactgagccaggcgtttgaattgatagatgcggccagtgaggccggcgcggacgcggtcaagttccaaatgtttcaggctgacaaaatgtatcagaaagaccccggcttgtacaaaaccgctgcgggaaaagacgtctcgatattttctttagtgcaatcaatggaaatgcccgctgagtggatcgaaccgctgcttgaatattgtaagaaaaaaggcgtgctgtttttaagcacggtatgtgacgaaggctctgccgacttactgtatgcgacttccccttcagcttttaaaatcgcctcctacgagctgaaccatctgccgttattgaaatatgtcgcggggctgaagaccccgattatcttctccaccgcgggcgctgatatttcagatattcaggaggcttatcaaaccattaccggcgaggggaacaaagaaattgcgatcatgcattgtgtggcgaaatatcccgcgccgcctgaatacagcaatctgagcgtcattcccatgcttgccgccgcattcccggatgcagtgatcggtttctccgatcacagcgcccatccgtatgatgtgccgtgcgcggcggtcaggctcggagcgaaactgattgaaaagcattttacgatcgataaaaacctgcccggtgctgatcactccttcgccctcaatccggatgaattaaaacaaatggttgcggcgatccgctcagttgaagcggagctgcggcaggggcatcacgcttcggtgccggaagtgctgtcgggaagctcccataaaaccacgacaccgattgaaggagatatcagaaggttcgcttacagaggcattttttcaacagcgccgattcaaaaaggcgaatgttttacggcggaaaaccttgccgtccttcgtcccggccaaaaaccgcaggggctccacccgagatattttgaacttttaactgacgggacgcgtgcggtcagggatatccccgctgacacgggcatcacttgggatgaccttttgacgaaaggcagcccatatgatgactgacattttgtttatcattcaggcgcggatgggaagcgggcgtcttcccggcaaagtgctgaaaccgatcggcgggtatacgattctcgatatgattgtcaaaagggttcggcaaagcgcgtattatgatcaatcgcgggataatctgatcgtcgccgcgtctgacagcaagaccgacgacattctgtctgcgcactgcctcagcaagaactaccgtgtgcaccgcggcagcgagcagcgcgtgcttgaccggtttgcacaagtcatcgaacgagtaaaaccggacatcgcagtcagactgacgggggataacccgtttgtcgacccttcgctgcttgattttctgattcaatcgcatttagatcagcacgcggactacacgtatatctgcggtacaccgcttggcatcggcggcgaggcggtaagcgcgcgacttttaacggagatcaatgccgacaaaacgctggcggacaaataccaggaacatgtcacgcttttaataagagaatctcctgagaggtaccggcttctctttcctgagcccccgcaggaactccgggctcctcacttgcggatgaccgtcgatacagaagaggactacaggctggcccgcgagctgtacgtaaaagcgggctcgcgtcctgatattccggcaaaagaattgatctatctgctgaatagtgatccggagctcagggccattaatcaaatgatccggcaaaaagaggctgattagcatgcgggttctgattttcgctgacgggggccgtgacatcggcatggggcacgcggtccggatgaagctgcttgccggtgccattaagaacaattgctcaataacgttctgcacaaataaagaggcttcttcttatctgtcatctgatcaatgggaagtgatcatcaagcctgacaagggacagaaggaatttattgtccgggaaataaacaggcaggctcctgaccttctcatattcgatctgctcgatatgccgtgtgactggttagaggaagtcaaaaagcattcatcggcacgcatcgtcttatttgaagaaaaacgggaacatgtcattcatttatgcgatgccgttataaacggcatttacggcgggctgaaaagccggacggtccaaatgggcagcgccgctgtatatgaaggcccggaatatatgattcttcatccgggttttgaaaaagcaaagcagctctatcaactgagaaaagaatgccggaccatattggtctcattaggaggaagcgacccgaagaagcttgtctttaaagtgatggaagcatgccgccgcatccccgacattcagcgaaaacgagtgatcatcgtcatgggcggcgccgcgcctcatgctgataacgtgcgcgcgcatcttacacaaatgccttatgccgagatggtaaggcagacaaatgacatggccgcgcttctttcgagggctgatatggccgtcgtgtccggcgggatcactttatatgaaaccatttgtacaggtgtgccctgcatcgtactttctcaagtggagcatcaaactgagacggcagaaaaattcgccgcacggggggccgccgttcatctcggccttggtgaatgcatatcaccggacgttctcgctcggcatatgtctgacatggccgctgattatccgatgcggaccggacttcatcaaaacggaaagccgctggttgacggcaggggcatcaaacgggcggcggcgattctttatgatttgtgataaaaccacacgtaaggaagtgttcatgtgaaaggtgttatcttagccggaggcaccggctcacgccttatgccgctgacaaaagcggtcaataagcatttactccctgtcggtccatatccgatgatttactggtcgatcatgaagctggaagaagcggggattacagatattttgctgattacgcaaaaagaatatattccgcaatttcataaacttctcgaaaccggagaagagctcggcgtctcaatcacatatcaggttcagccagccgcatccggcatttccgacggtttatcatacgcaaagcgatttacaggtcgcgatccgttcgttctgcttttgggagataatatttttgaagattcattaaaaccttatacggagcgtttcgcaaagcagggaaaaggagcgaaagtgctgctgaaagaagtggacgacccggagcgcttcggcatcgccgagattgatgaggaaaacaaacggatcaagtcgatcattgaaaagccggagcagccgccgaccagactatgcgtcacagggatctacatgtacgacgcagaagtgttttcctatattgaacaaatttccccttcaaaacgcggcgaactggaaattacggatgtcaataatttatacattgaacacagtgagctgacgtatgatgtgttaacgggctggtgggtggatgcgggcacgcatgaatcgctctacctcgccggaagcctggcgcatcaggcattacagaaaggacaggagcattaatcatgccaaaatcatatttaattacagggggcgccggatttatcggccttacctttacaaagatgatgctgaaagaaacggacgcgcagattaccgtcctggataatctcacgtatgcaagcaggccgcttgaaatagaagccttaaaaaagaacggccgtttccgttttatcaaaggtgacatttctgaaaaagaggacattgacaaagtcttttcccaaatgtatgacgctgtcattcattttgcggctgaatcccatgtggacagaagcataaatcaggcagagccgtttatcacaacaaatgtgatgggcacataccgactggcggacgcggtgttacagggaaaagccggcaggctgattcacatttccacagatgaggtgtacggagatttggcgccggatgatcccgcttttacggagacgacgccgctttctccgaacaatccgtattccgccagcaaggcaagctcagacctgctcgtcatgtcttacgtgagaacccataagcttcctgccatcattacaagatgcagcaacaattacgggccgtaccagcatcacgagaaaatgattccgaccattatcaggcatgccgtaaacggcacgccggttccgctgtacggcgacgggatgcagatcagagactggctgttcgccgaagatcattgccgcgccattaagctcgtgctggaaaaaggaacactcggtgacatttacaatatcggcggaggaaatgaacggacgaataaagagcttgcgtcatttatcatgaaggagctcggtgtcgaggaacggtttgctcatgtcgaagacagaaaagggcatgaccgccgttacgccatcaatgcttcaaagctgaaaaatgagctgggatggcggcaggacgtcacatttgaagaaggaatgagaagaaccattcgctggtatacaaacagccaagactaatcggaaagaaggggatccgattgacgaaggtattagtaaccggagcggccggccagctggggcgggagttatgccgccagctgaagcgggaagggtatgaagtgatcgccttgacaaaagcgatgatgaacatatccgaccagcgttcggtgcggcactcgttcagccattacaagccggatatcgtcgtcaatacggcggcatacacctccgttgacaaatgtgaaacggagctcgacaaagcgtatttaataaacggaatcggcgcttattatgccgcgcttgaggctgaaaacaccggcgcgaaattcattcacatcagcaccgattacgtcttcagcggcaaaggaacacggccataccagaccgatgatcccgcagatccgggcacgatttacggaaaaagcaaaaaactcggcgaagaactgatccggttaacgggaaaaaaccacaccattatcagaacgtcgtgggtgtacggcagcggcgggcacaactttgtcaatacgatgctgaaacttgcggatacacatgatcaggtgcgtgtcgttaacgatcaagtcggagcgccgacgtacacaaaggatttagccgaaacggtgatcggtctgtttgacaggccgccgggcttataccacgccgcaaacagcggagtgtgcagctggtatgaatttgccaaggctatttttgaagaaagcggcagaaccgcctccgtgctgcccgtcacgacggaggaatacggaaatgagacgccgcgccccgcttactcggtgttgagtcttgagtcgattgaacggcaggggctcggcatgaggcattggcgggaagcgctgcatgattatttacaaagggagggacagtgcaagtgatcgaaggcgtaaaaatcaaaaagctgatcaaacacagcgatgaccggggttttttctcagaactcgtccgtgacgatgaacatctcttagagcgtttcgggcaggcttcctggtccaaaagctaccccggcgtcattaaagcatttcactatcatgagaaacaggatgacctgtggttttttccgacgggccacgcccaggtcgtgctgcatgaccttcgcgaagagtcggcaaccaagggagaaacggatgtctactacatgggagaagacaatccgatgctccttctcattcctaggggcgtcgcacacgggtacagagtgctgggtgaaaccccgctgaccattatttatttcacgacaatgtcctacaatccggatcagcctgacgaaaaaagaattccgtggaatgatgacaccatcggatttgactggcagacggctcaccgatagcgcacaagacgaagacagcggatgtcttcgttttttgtgctgattcatctcgtgaaaaataaatgattgaatattctaaaaaataatttacttccatggataaaggtggtagattattctcaggaaaagagaaacccaattcgcgaatggaaccatcagacacgcttttccggcagaggacgctctgaatcccatatgatctggaggaattcatgatgttaaaaagaaaatcattttcggcctttctcatcagtgctgcggtattttcatctgtgttcttgccatcttttcatgcgaacgcccaatctgccgttattgaagcgaaaaccgtcaatagtacgaaagaatacgcgacgtctgatattgaagtcacatacaagccgaatgcgctgcttgccgtcggcgccgttgaatttcaatttcctgacgggttcaacgccactgtgagggactctgtaaacggaagaacactgaaagaaacgcaaattctcaactacggaaaaacggtcagacttccgcttacccttgacttattgggcgcgtctgaatacaatctcgtcctagtgcgtaaaaaccttccgcgcgcgggcgcgtatacaattaaaggcgattacgtaaacggtttgggggccggcagtctttatgccgaaacaaagctggttattgacccgcgttaatcggggatgaaagaggctgacaacagcctctttttttttatgcgcaaaaaacctggcatgaatcttgcatataaaaagggcgtaacgacaatgtgaaagggtttgatgggttttggtgtaaaagcgcttacattttgttctgccggtaattgaagcttacacgtaaaatacgatgaggtgataaacatgtcagccaacccgctttctaaaagcaatcagaaagatgaagaaaaagaagttcttaatttgttcttgtcaacacaatcgatcataaaagaggccctgcgcaaactgggctatcctgacaatatgtatgaactgatgaaagagccgatgcggcttttaaccgtccgcatccctgtcaaaatggacaatggctcagtacaggttttcacgggctaccgctcacagcataatgacgcagtcggcccgacaaaagggggcgtgcggtttcatccggaagtcagtgaagaagaggttaaggcgctttccatctggatgactttaaaatgcggcatcacaaatcttccttacgggggcggaaaaggcggcatcatctgtgatcctcggacgatgtcattcggagagctggaacggctgagccgcggatatgtgcgtgcgatcagccagatcgtcggtccgacaaaggatattccggctcccgacgtatataccaactcgcagattatggcatggatgatggacgaatacagccgcctgagagaatttgattcaccgggattcattacgggcaaaccgattgttctcggcggttcacaggggcgggaaacggcgaccgcgcaaggcgtcacgatttgtattgaggaagccgttaagaaaaaagggattccattggaaaatgcgcggatcatcattcaggggttcggaaatgcggggagctttctcgctaaatttatgcatgacgccggcgccaaggtgatcggcatctcagacgcccacggcgctttgtatgaccctgacggccttgacattgattacctgctggataagcgggacagctttggcacggtgacgaatctcttctcggatgtcataacgaacagggagctgctggaaaaggactgtgatattctcgtgcccgctgcaatctccaatcagattacggctgaaaacgcccatcacattaaagcttcaatcattgtggaggcggcaaacggcccgacaacgatagatgccacgaaaattctgaatgaaagaggcgtgcttctcgtgccggatattttggcaagcgccggcggcgtgacggtgtcttattttgaatgggtgcaaaataatcaaggcttttactggtctgaggaggaagtcgccggaaaactgcgcagcgtcatggtgaattcgtttgaatccatttatcagacagcgcatacccacaaagtcgatatgcgtttggccgcctatatgacgggcatcagaaaatcggctgaagcggcccggttccgcggctgggtataagtgttatccgcaaagagattttgcatcagttatatagcggatcgcaaaatttctttgcgttttcagattgcagctgacagattcggacaagcttcgtccgctttcggcaaagattttcttatttttatcacaaattgctatgctggtatgcttcttgcatcatcataaagcgtgagcacacattacaaaatacggggaggaattctaatgacagtttcatacgcacacgaaccatttacaaattttcaggaagagacaaataaacaatcgtttcaggaagcgctggcttatgtgaattcacagctcggcaagcattatccgcttatcatcaacggtgaagcgattgaaacggataaaaagatcatttccgtcaatccggcagataaaaaagaagtgatcggttctgtatcggccgccggaaaagaacttgcggaaaaggccatgcaggctgcgctgcaggcatttcaaacatggaaaaaagtacggccggaacaccgcgcgaatgtgctgtttaaagcggcggcgatcatccgcagaagaaagcacgaattctccgcgtatctagtgaaagaagccggaaaaccgtggaaggaagcggatgcggatacggcggaagcgatcgactttttagagtattacgcccgtcagatgctgaaactgaaagacggttcccctgtaaagagccgtgacggagaatataatcagtatcactatgagccgcttggggtggggatcgtcatctctccattcaacttcccgcttgcgattatggcgggaacggcggcggcagccatcgtaacaggcaacacgatactgctgaaaccggcggatgcggcgcctgtcgtggcggcgaaattcgttgaagtgatgaaagaagcgggcctgccggacggcgtgctccaattcataccgggcgacggaggagaaatcggcgactatctggttgagcatccgaagacgagatttgtgtcgtttacaggttcccgcgcggtcggatgccgtatttatgaacgcgccgcaaaagtacagccgggccaaaagtggctgaaacgggtcattgccgaaatgggagggaaagatacggtgcttgtagacagagatgctgatcttgatcttgccgcttcctcaatcgtgtattccgccttcggattctcaggccaaaaatgttcagccggttcccgtgcggtcatccatcaggacgtctatgatgaagttgttgaaaaagccgtcgctttaacaaaatcactcaccgtcggaagtccggaagattttgatacatacatggggccagtcatccacgaagcatcttataataaagtcatgagttatatcgaaatcggcaaaacagaaggaaaactcctgacgggaggcgaaggtgatgattcaaaaggatactttattcagccgaccatttttgcggatgttgatgaaaacgcccgcctgatgcaggaggaaattttcgggccggtcgtcgcgatctcaaaagcccgtgatttcgaccatatgcttgagattgccaataataccgattacggactgacgggcgctctgttatcgaaaacccgcgcgcacattgaacgcgcccgcgaagattttcacgtcgggaatctatacttcaaccgcggatgtacgggagcgattgtcggataccagccgttcggcggtttcaatatgtcaggaaccgattcaaaagccggaggacctgactatctgattcttcatatgcaggcaaaaacaacgtctgaagcctattaatctttcggaaatagcgcgatgaaaaagagagtcgcgctattttctctatatgagggtaaggaggatggaatatgtatcagcagctcagcaaaatgcttccggaggagaaaatagaagccattacaaaatcactggtggcgttaaacagcatcaacggcacattgggagaaggaaaaaaagccgactatatcaaagatatgatcaagagctttccctactttcaggagaatccgtcacatgtgtgggagcaggcgattcctgaggacccttacggccgcaaaaatattttcgcatttattgagggtaacggcgaaagcctgaatacggtcatttatcacgctcatcttgatacggtcggcatcgaggatttcggccctttaaaagatatcgcttttgattccggccgtctcgcggagtatttctcaaactatgaatttgatcgggatgtgcagcgggacgcccgctcaggcgagtggatgttcggaaggggttcggttgatatgcagagcggtattgccgttcatctcgccaatctgcttcacttttctgaacggcgtgatcagctgccgggccatattctgttcatggcaaacccggatgaagaaagccagcattccggcattttaaccagcatttctgaattaaaacggctgaaacaagaaaagcagcttcgttatttagcagcgattaataacgattttatcaccccgctgtatgagggtgacacgacaaggtacatctacacgggcgcggcagggaagcttttgccttgctttgcgatttacgggcgggaggtgcatgtcggtgatacgctgtccggcatcgatccgaatttgatcgcgtcagaaatcaccagaagaattcacaacaatattcatatggcggaaaacattgaaggggagcttgtgcttccgccgacctgtctctaccagcgagacaacaaggaagcgtataacgtgcagaccgccgtcagcagctatgtctattttaattattttatatacgagaaaaccgccaaagaagtcatggatcagctgaccgccgtggctgacgaagcctgcaaagagacagaacgaaaattatctgattattacgacgaatactgtgagagaacgagcttgccgaaaaaagagatgtcatggaacgttcaagtgtacagtctggaagattacctgaaaaggctgagaagccgcgggatagaccctgcacagtgtatcgggcaggcatttaaaacatatgaacatcttgaactgcggatgagatgctttaaagccgtcgaggaactgcaaaaactcgatcctgagcagggagccaaggtcattattttctatgcgccgccttaccttccgcacaattatctgaaagaagagagcacacgggaccggcttttgcagcatgtcattcaagaagcggtcgataaaacagcggcgtcaaccggagaaacattcgcctttaaaaagtttttcccttatttagcggacggaagctttttatcgctgcatgaaacagacgaggaggtctccgcctttaccgataattttccgggctgggatgtcatcgggacgattccttttaaagaaatcagggaattgaatattccgtcggtcaatataggggtatacggaaaggacggccataaatggacggaacgcgtgtacaagccgtacacattccatgtgctgccggaactcattcagcagacgacaatgcaccttttgcacagctaccgattagacatacgcacaaatggctgacataacggaataagggggatgtatatgcagggagataccaatcaaactgaattgcagcgcacgatgaagggccggcatttgtttatgatcgccctcggcggcgtgatcgggacggggctttttctgggctccggttttacgatcagtgaagcgggaccgatcggcgcgatattggcttatgtgatcggcggatttttaatgtatctggtgatgctttgtttgggggagctcgcggtcgccatgccggtcgcaggatcatttcaggcgtatgcggcaaagtttctcgggccgtcgacgggatttacgatcggatggatgtacgcattcagctgggccaatacagtggggcttgaactgacgtcggcggggattttaatgcagcggtggtttccgggcgttccgatttgggtgtggtgccttgtattcggcgtcgtcattttttccattaacgcgctgtctgcgcggagttttgcggaaatggaattttggttttccagcattaaggtcatggccattgtattgtttattattctcggctgcgctgcggtattcggctttgtcggttttaacggcgggcagacggctccgtatctgtcaaactttacgacggacaaagggcttttcccgaacggtgcccaagccgtgctgtttacccttgtcatggtgaatttttcattccagggcaccgagctggtcggaatcgcctcgggagaaagcgaaaatccggaaaagacgcttccccgctcaatccgaaacgtcatatggcggacgctgtttttcttcgtgctggcgatgtttgttctcgtgtccattttgccgtaccaaacggcaggcgtcatcgaaagcccgtttgtggctgtgctggataaaatcggcgttccctatgcggctgatatcatgaactttgtcatcctgaccgccatgctgtcggtggcgaattccgggctgtacgcttcgtccagaatgatgtggtccctatcaaaaactaagatgggtcccgcttccttaacgaaactgacgaaaaaaggcgtgcctctgaaagctctttccatcaccatcgctatctccggtttatccctgctgacaagtgtattcgcggctgaaacggtgtatgtgtggctcatttccatctccggtatgattaccgtcgtcgcgtggatgtcaatctgcgcttcacaattcgttttccggagacgctttctcgctgaaggaggaaatctgaaagacctggcatttaaaacgcctctttatccgatcgtgccgattctcggattttcggtttacggtcttatcttaatcagtctcatctttatccccgaccagcgtatcggtctgtactgcggcgtcccgctgatgatcatctgttacgcgtattatcacttcggtattaaaaaacgcctgaatcgtgagccggcttcttcgaaaaaaggcgctgccggataagaaaaaaagccctccgcaaaaagcggcgggctttactttgtttttcgtttggccgacagcacataggatagaacggcaaagaactcaaaaccgaaaatgctgacggccatcggccaggcattttcttctccggcaatcccgacaaggggagcggcagccgcaccgccgataaagggcaggagtccgagaagagccgcagcgcttcccgcgcctttctcctgtttctgcatagccagagaaaaccctgtcgtcgtgacgatcccgacagaagaaacaatgatgaataaagaaatgcagaccgccgtcaggcctaaaccaaacgcaagtgataaaagcaaagcgatgcttccgatgacggcgatcaaaagcccggagacaaacagcttccgttcatcatgtgttttggccatccgtccggtgatttgggttgcgcatatgattcccgcaccgtttacggcgaacagcaggctgaacatttgcgccgatacgccgtagatgttttgcagtacaaacggcgacccggcaatatatgcgaacatgccggtcatcacaaatgcctggctgagcgcaaatcccataaacatccggtcgccaagcaggccgcgaaacgtcatcagcgtctcccggagtccgccgcttgtccgcttttccggcgggagtgattcaggcaacgccgtaagcacggcggcagtaatgatacagccgatcaccgccagcacgacaaatacgattttccagccggcaaactgaaggataaatccccctgtaatcggcgctaaaatcggtgccgccccattgacgagcatcagtaatgagaaaaaagccgtcaattcttttccggaatacatatcgcgtgcggacgcccgtgcgatgacgattccggccgccccggtgaatccttgaataaacctcatgacaattaaaaacgaaacagaagggctgaaggcgcataataaagaagacagcgtataaagcagcaatgacagaatgagcggcttccggcgcccgatcatatcactgagcggcccgacaacgatctgcccgaccgccagccccaaaagacaaaacgtcaggctcagctgcgcaagtgacgctgtcgtatgaagatcggccgccacttcaggcaaagcgggcagatacatatcgagcgaaagcggcccgaatgaagcgagcgtcccgagaatcagtaccatgccgaggcctgcgcgggcggcctttgaatcagcgttattcatttcatgacccccaccttaacaaatgattctatcactatagcataaccggacgacgtattttatatcatttgttgaatacaaactaaatattttatttaaaatctgaatgtaaataagaaaacagaattagttttcatttgaaatgtaaaatgaaacataaggatgctaaactataaaacaacaaaaggtagaaaagttttacggaagaggtgttcaaagagcatgaacagcaaacaaaccgatcacatcgaaacgaaacgccgatttccgatctgtctcgcgcttgctttgacattaggcgtatttgccgcgggttctgaagagctggtgatttctccgctgcttccggatttagcgcgggcattcagctcggatgtcagtgtgctggcgctttccatcagtatttacggagtgatgatttttatcggtgcgccgcttctcgttccgctgggcgataaatattcccgggaactcagcctgatggcggggctgcttatatttacggccggcacggtgatctgcgcgctggcgcacaatctctttttcttctttctgggcagggcgctttccgggcttgcggcgggtgcgtttgtgccgacagcttatgcggtggtcggcgaccgtgtgccttatgcgtaccgcggcaaggtgatgggtctgatcgtgtcaagctggtcgctcgctttgattttcggcgttccgatcggctcttttatcggcggcgttttaaattggcggtggacgttttggattttcgccctcatgtctgtcctcgttgcttcgctcattttcattgaggcgcgccgcagcacggcggatggggataaaacagaagaggaaaacggccggcaggcaggcactttccgggatgcgctgaaggtgccccgtgtccctgtatacctcacgatcactttttgcaacatgatcggtttttacggcatgtattcctttctcggcacatatcttcaccgcgtgctgccgggggggaatacagcttcagggctgctgatcatggtgtacggaatcggtttttccatgagcgtgttcaccggaaaaatcgcagataaggcggggaaaatgcgctctttgatcgcggcattggccgtgatcagcatatggctttcctgtctcgcctatgcgccgtcatcaatgccgtttttggttatcgggttattcgtctggggattgatgcaaagcctgacggtgaccttgctcagcaccattttaagtgattgctcacagagccgccggggcaaaatcatggcattttacagtctggcgtccaatttggccgtcaccttgggttctgctgtcatgggtccggtctatgtcggatacggatatgcggctgttggatttatctgtgcggccgtcaccctcatcggctttgtcctcagcgttttcgcatacagaaggtatgggaaatatgagcatcaggccgaccaatcattgtatcggtaaaataaagtttctataattttgtaaatgttaatttttagcaccctatttcatagggtgttttctaatatataggaataattatcaatattttcaaataatattgacagcttgaacgtctatggataatatttacttaaaatttaacagattggttggtgctcatgattatattggataatagcattcaaacgaaaagcaaggcttattcaatatctaaactgattacgatcaacacgctcggtcctgaagggacaagcagtgagtacgcagcaaaaaacttcatcaccaattttacccttctccaaggggtgaacagtaaattatcactgcatgatacatttgaatcgtgcattgaaaaaacgcttcaaagtccgctggaatacacaattgtgcctcacgcgtatgacggcattaagcacttctacatgagaccggatctgcagcttctgcaaattttcaggtgcgacaccccgatgtacggcctggctgtccggcccggttttgaatatacggatgacatgcttgatcagactgtcatcgtatcccacccgtctcctatcaatttgattaagtattttacccgtaaagatgtcacgtttgatctggtgaactcaacgagcgcagccgcgaaaagagtgaaggacggtttgtccgacatcgcgctgacaaatgagctggccagacaaaagtacggccttcactttgtcaaaacatttaaaagcattcccatgagctggtcattattcggaaaaggagagattcatgatgaaaactgaacaagatttgcaggaactttatttcccgacgcctaaattaatagaatgggataacggagtaagacaatattcgtccgtcagaggagatacggaagttctgctttcttacgttccgccgcatacaaacgtggaaccgcatcagcataaggaagtccaaatcggccttgtcgtttccggcgagctgtccatgactgtcggagatgtcacaagaaagatgacagcgctggaatcagcctatatcgcgcctcctaatgtgcctcacggcgcaagaaatgagacggatcaagaagtgatcgccattgatattaaacgcctgaaagccggtgaaacctacacaagccctgaagattattttttgaatatttttaaaacgagagacttattgcccggtatggaagtcacgttcttcgtggaagactgggtggaaatcatgcttgccaacattccgggcaacgggggagaaatgccgttccataaacaccgcaatgaacagatcggcatctgcatcggcggcggctatgatatgaccattgaaggctgcaaagtggatatgacattcggcacagcttatttctgcgatccgagagaagatcacggcgccatcaacagatttgaaaaagattcaaaatcagtcaatatctttttccctccgcgctataacagagcaaaagcgaaaaaattagaggcggaagagtcatgaacctgacggataaaaccgtcctcatcacagggggcgcatcaggcatcggttatgccgcggttcaggcgtttctgaatcagcaggcgaatgtggtcgtcgcggatattgatgaggcgcagggagaagcgatgatcaggaaagaaaacaatgacaggctgcattttgtgcagacggatattacagatgagccggcatgtcaaaacgccatccagtcagcggcggacaagttcggcggattggacgtgttaatcaataacgccggcatcgaaattgtcgccccgattcatgagatggagctgagcgattggaacaaggtgctcaacgtcaatctgacgggcatgtttcttatgagcaagcacgcgctcaagtatatgctcaaaagcggcaagggcaatatcattaacacgtgctccgtcggaggagtcgttgcatggcccgacattcccgcatataacgcctctaaaggcggcgtattgcagctgacgcgttcgatggctgtcgattacgccaaacacaacatccgcgtcaattgcgtgtgcccgggaatcattgacacacctttgaatgaaaagtcgttccttgaaaacaacgaaggcacgcttgaagaaatcaaaaaagaaaaagcgaaagtcaatccgctgctgagactcggcaagcctgaagaaatagcgaacgtcatgctgtttctcgcgtcggatttatcaagctatatgaccggaagcgcgatcaccgcagacggtggatacaccgcacaatagagaaggagtgtttacatatggagagaaaaacagtattggttatcgctgaccttgggggatgcccgccgcatatgttttacaaaagcgcagccgaaaaatacaacctcgtcagctttattccaaggccttttgcaattacagcctctcatgcggcattaattgaaaaatactcggtcgcggtcataaaagataaagactattttaagagtctggctgattttgagcatcccgattcgatttactgggctcatgaagatcatgacaaacctgaggaagaagtagtcgaagaaatcgtcaaggtggccggcatgttcgcggttgacgccattacgaccaacaatgaactgtttatcgctccgatggcaaaagcgtgtgaacgtctcggcctgcggggagcgggcgtacaggccgctgaaaatgccagagataaaaacaaaatgagagccgctttcaaccgggccggcgtcaagtctatcaaaaacaaacgggtgacgacgctggaagatttccgcgccgcgcttcaggaaatcggaacgccgctcattctaaagcctacatatctggcgagctccatcggcgtgacgctcatcaaagagagggaaacggcagaagccgaatttaacagagtcaatgaatacctgaagtcgattaacgtaccgaaagcggtcacgtttgaagcgccgtttatcgcggaagaatttttgcagggcgagtatgacgactggtacgaaacaagcggttattccgactatatcagcatagaaggcatcatggccgacggagaatacttccctgtcgcaattcatgataaaacaccgcaaatcggattcacggagacatcgcatattacgccgtccatcctggatgatgacgcgaagcggaaaatcgtcgaagcagccaaaaaggcgaatgaaggactcggcctcgaaaactgcgcaacacatacagagattaaattaatgaaaaaccgggaagccggactgattgaatcagcggcacgatttgcgggctggaacatgattccgaatattaaaaaggtcttcggcgtcgatatggcgcagctgttattggatgttctctgtttcggaaaagaagccgatctgccgaaaggattattggagcaggagccatgctatgtcgccgactgccacttgtatcctcagcatttcaaagaaaacggccagctgcctgagacggctgtcgatttcgtcattgaaagcattgacattcccggcggcgtcttaaagggagacaccgaaatcgtttctttctcggcggccgaggcgggtacatccgtggatctgcggctgttcgaagcgttcaacagcattgcggcgttcgagctgaaaggaagcaattcgggtgacgtggccgaatcaatcaaacaaattcagcagcaggcgaagctgactgcaaagtatgcgttaccggtatgaaacagctgaaaccgaactctaagtatttgcttttcgggcaggcgctttcgtttatgggagactattgcgttctcccggctctgctcattttgtctacatactatcacgactactgggtgacgtccggcgtcatcgcggtccgcagtattccgatggtgtttcagccgtttttaggcgtgctcgtggaccggctcgacagggtgaaaatcatgctgtggacggatgtgatcagaggcgtcatctttttggggctgacatttctcccgaaaggcgaatatccgctgctttttctggcgctgctgtttgtttcttacggaagcggcgtgttttttaacccggcacgtctcgcggtcatgtcgtctttagaagcggatattaaaaatatcaacactttgtttgcaaaagccacgacgatttcgattattgtcggcgctgcagccggcggactttttctgttaggcggttctgtggagcttgccgtcgcgtttaacggggtgacctatcttgtctccgcgtttttcatcagccgcattaagcttcaatacgtgccgattcagtcagaaaacgtaagggaagcttttcagtcgtttaaagaaggcctgaaggaaatcaaaacaaatgcttttgtgttaaacgccatgttcacgatgattacgatggcgcttttgtggggtgtcgtctacagctatttcccgattgtcagccgctttttaggcgacggggaaatcggcaatttcatcctgacgttctgcatcggcttcggcggctttatcggcgccgctcttgtcagcaaatggggctttaacaacaataaagggctgatgtattttacagtgttatcgatcgtctcgcttgcgctgtttttgtttaccccgattttcgccgtgtcagtcattgccgctattcttttctttatcgcaatggaatacggtgaagtgctggcgaaggtcaaagttcaggagaacgcggcgaaccagattcagggccggatcttttcggtggcggaggcgtccatcggattgtgcatcgctgtcggttccatgctgatcaatattgtagacgcggcagtcatcatggcgtttatcgtccttttggtcagcgggctgtttctgcatacaaaactggtcaataaatccttttcagaacggaataacgaatcagagcaaattcatttataaggagcctttcagatggaaatcataccgtccgacgtcatcaagacacttccgaaacaggaattttcgctcgtttttcaaaaggtaaaagagatggagaaaacgggagctcagatcattaacctcgggcaggggaatcccgatctccccacaccgccgcatatcgttgaaacattgcgggaggctgcgctgaatccttcgtatcacggatacggcccgttcagaggctatccgtttctgaaagaagccatcgcggaattttatgagagagagtacggggtatcggtcaatccggagacagaagtcgcgctgttcggcggagggaaagctggtttgtacgttttgacgcaatgcctgctgaatcccggcgatatcgccttagtcccgaaccccggctaccctgagtatttatcgggaattacaatggccagagcggagctgcatgagatgccgcttcatccggaaaacggctatttgccggattttgagcggattgatcccgccgtcctgaaaaaagccaagctgatgtttttgaattacccgaataacccgactggcgcgactgcggatcaggcgttttatgaaaaagcggcagcgtttgcaaaaaaacatgacatccaccttattcacgattttgcatacggcgcgttcgaatttgatcagaacccggccagctttcttcaggcgaaagaagcgaaaacggtcggcgcggagctttattcattttcgaaaaccttcaatatggcaggctggagaatggcatttgccgtggggaatgagaaaatcattcaggcggtcaatgagtttcaggatcacgtcttcgtcggcatgttcggcggtcttcagcaggcggcagcggcggcgctgtcaggaagtcctgagcatacggagcgtctgaagcgcacatataaagaacggattgactttttcacggcgttatgtgaaaaggaattaggctggagcattgaaaaaccgaaagggactttttatgtatgggctgaaattccgaatgaattcgagtcttcacaccagttttcggactatctgctggagcatgcccatgttgtcgtgacgcccggcgagattttcggcagcggcggaaagcgttatgtcagaatatcaatggtggcaaaacagggtgatttaagggaattcgtgctgcggattcaaaagctcggtttgtcctttccttcattacaagaaacatcccgctgagagcgggatgtttttattatatgcttttcatgctgccgccgtcggctgacacttgctgtccggtaatataggaggcttcttcagaggcaagaaaggcagccagcgccgcggtttcttccggagttccgacacgcttcatcgggacgcctgatgcaatccgttcttccgcttccgctttagaaatgccgttttgcttcatgacattcttcacgaattggtgataacggtctgtggcgataaacccgggattcagacagttgacagtaatgtgaaaaggcgcaagctgaatggcgatgtttttgctggcattaattaaagcggcgttcatcatgctgttggtaaacatattggcgccgggttctttccataggtttccgacgatattaatgattctgccgaattcgtgctgtttcatgattgctgcggccgttttcatagagtcgatataagcgattgttttattcgtaaaggtatttgtcatatcctctatatcgcagttttcaaaggtatccggcgagccgcccggaatgttgttgatcaatacatcaagccgtccgcattgtgatctgatctcttcaaaaatgccggctcttgtcttctgatccgacatatccccggccagaacggtgacgcccgcatccggatgtttggcgaggatctcttcttttaccgattcgatattttcgggaactcgagaattaatgacggtatgaaagccattgtccgccagtttcagagcgatcgctttgccgatcccctgactggctcccataataaacgcggttcgttttgacaactgtctgcacccctttaccaaaatggaatctcctttacatcgtaaaaaaaaatgataaaaatagcaaattttatttaaattctgacaaaggaaaaacccgccggacaggcgggtggttgttacacgtgcaaaaacttcggaagcgtgtcaagagacaagcggtttccgacaaaaaatgaaccgaattcgccgtagcgcgcgctgacttcatcaaagcgcatttcgtaaacaagttttttgaactgaagcacatcatcgctgaagagcgtgacgccccattcgtaatcgtcaaaaccgacagatcccgtgataatctgtttgactttgccggcatagctccgtccgatcaagccgtggcttctcatcaggtttctgcgttcatccatagaaagcatgtaccagttgtcattgccgcttcttcttttatccatcggatagaagcagacgtatttcgcttcgggcagctcaggatacaggcgggcgcggacatgcggattttcatacggatcgccttctccgcttgcgaggtagttgctcagctcaaccacggacacgtaagaataagccgggattgtaaattcagcaagctttgatttgttaaattcaagctcgatttcgttcagctcttccattgtcgggcgaagaatcatcagcataaaatcagctttctgtccgacgatgctgtagatggtttgcgagcctttgccttctttttgggcgacaccccatttttcaagcagtcccgtaaattcgtgaataatcgacaggcgctcatcgctggataacatcttccatgacgtccagtccattgtgcggaaatcgtgaagcgcgtaccagccgtcaagcgtttgggcggcttcgttcgttttttgctgctcactcatgtatcttcactcctatatcttttcattacattgatgccttcactatatcacagtttaaccgtttcggctgtggagaaaccttgaataatccgaagccttgtgtcagaaactatgccgtgaacaaacggtcaattaaattagttagaaaaataagatttctttttgaaagcgctataatagaagttggttatttgaatttagctggaagaagagtatgctgtaaaagtaagcgttttttgtcaacatagaggagggtatatcgtggcagatttatttacaaaagtacaagaaaaagtcgcaggaaaagatgtgaaaatcgtatttcctgaagggttggacgaacgtatcctggttgcggtcaacaacttggcgggcaacaaggtattaaagccgatcgtagtcggcaataaagaagacattcaagcaaaagcgaaagaattaaatcttacgcttgacggcgtggacatttttgacccgcatacatatgaaggcatggaagaactcgttcaggctttcgtagaacgccgcaaaggcaaagcgacggaagaacaggcccgcaaagctttgctggacgaaaactatttcggcacgatgcttgtgtacaaaggtctcgcagacggacttgtcagcggagctgcacattctactgctgatacggtgcgccctgcactgcaaatcatcaaaacaaaagaaggcgtgaaaaaaacatcaggcgtcttcatcatggcccgcggtgacgagcagtatgtgttcgctgattgcgcgatcaacattgctcctgacagccaggaccttgccgaaatcgccattgaaagcgccaatacggctcaaatgtttgacattgacccgcgcgttgccatgctcagcttctctacaaaaggatcggcgaaatcagacgagacggacaaagtggctgaagcggtgaaaattgcgaaggaaaaagcgcctgagcttacgcttgacggcgaattccaattcgacgctgcatttgtgccgtctgtcgcggagaaaaaagcgccggactccgacattaaaggagacgcgaatgtatttgtattcccaagccttgaagcaggaaacatcggctacaaaatcgctcagcgcttaggcggctttgaagcggtcggaccgattctgcaaggattgaatatgcctgtaaacgatctttccagaggatgtaatgcggaagacgtctacaatcttgcgttaattacggctgctcaagcgctgtaatccgcaaaagccggcctttacgagggccggcatttttttatagaaagaacgtcactgcggcccagccgaacagggacaaacagagagaaccgatcaagcctgctgcgagcgcccgccagccgttatgacgaaacgccgatatatggactttcaaaccgagacccgccatcgccatgccgattaaaacataagacacttgaacaagaaacgcggaaaacgaggctgaaataacgcctgatgtatggatggcgctcattccgagaaatccgaagataaaccaagggatggggagcgaagcggcagaagccgtctttgactttccgctgcggcgcgcccgcattccgagcatgaatgcggccgggacgagcagcgcgacccgggtcagtttgacgatcaccgccatctcgacggctgcttttcctccggcgctgccggccgccgccgcatgcgccacctcgtgaagcgttgccccgcaaaaggctccgtaagccgcaggagaaaagcccaatccatgataagcaagagaatatacaacagtaaaaacggttcctaataacgaaacggcggccgcgctgatggcggctgcattttcatttgatctgatctgcggcgcgatcgcggcaatggcagccgccccgcagatcgctgtgccgcaggctgtcagcgtgctgagtgtctgatctatacggaacagccgggacagtccgtatacaacggcacccgcaaacatcatacagcagacggcaattgcaaatacgtgccagcccgcatgatagatatccgccagattcagtctcatgccaagcaggatgatgcctgctttcagcaagtatttgcttgagaacgcgatccccggctctaatgccgcccgctgtccgaatacggcgcgccagagcatgccgatcagcattgcaaggacaagcattccgagcatttgcaaaaacggcaggcggctgacatagaaagccgcaaacgcaattcctgcggtaactgaaacaccttttaccatcttcatctcagtcacttcccattatcttgataactccactttactgcggtcttaatcattagtaaaatatatttatatgatctaaacgattaggaaaaataatgattaggggcgatgctttttgtattatggggaactgaaaacattcattgccgtcgtggaagaaaaaaactttacaaaggcggcgcagaagctgatgatttctcagccgagcgtcagccttcacattaaaaacctggagaaagaatttcaaaccgccttgctgaaccgctctccgaagcactttacgactacgccgacgggggacattctctatcagcgcgccaagcagatggtctttttgtacgaacaggcgaaatccgaaatttacgcccatcatcattatgtcaaagggaagctcaaaatcgccgcgagctttaccatcggcgaatatattctgccgccgcttctcgcaaagcttcatgacgagtatcccgagctgaacctggacgtcatgatcggaaacacggaggaggtcagcgaagcggttcggatgcttcaagccgatatcggattaattgaagggcatacggggaaaaacgagctggacattcagccgtttatggaggatgaattgtgcattgccgcaccgaacggacacccgctcgccggcagaaaaaacatcccggctgccgaattgcaaaatcaagcgtgggtgacgagggagaagggttcgggaacgagggaatatttagaccacgtccttcaatcaaacggactgcggccgaaatccatgatgacgatcagcagcaaccagggcgtcaaagaagccgtgatcagcggaatgggtctttccgttctgtcaaaaagcgtgctgcaaaaggatctgcttcacggcagcatttccgtgcttgagataaaaggattctccttaaaacggaaactgtctatcatccaatcttccattatggagaacacaaaaaacaaagaaatcttcatcgctctattgaaaagccaatttcaatcatcacaagcggagtgatataataaatgcatggaaagcctatgacgaaagggatttaaaatagatgggaaagcaaccgattgatttactgatgcagccgagctggagaatcattgaccaatccagcctcggcccttattttgatgcgaagcagtcattcgcaatggatgatacgttgtgcgcctccgtaggcaaaggggaatcgcctgcgacggcacgctcttgggtgcaccaccggacgatcgtgctcggcattcaggacacgcgcctgccgtttttagaggacggcgtgaaattgctggaggacgaaggctatcgtgtcattgtccgcaattccggaggcctcgccgtcgtactggacgaaggcgtattgaatatctcgcttatttttgaagacgagaaaaaaggcatcgacatcgacagaggctacgaggcgatgacagagctggtgcggcggatgctgcgtccgcaccatgccgaaattgaagcatatgaaattaaaggatcgtactgtccgggcagctatgatctcagcatcggcggccgaaaattcgcgggaatctcacaaagacgcctgcggggcggaaccgcggttcagatttacctctgcgccgataaaagcggaagcgaacgcgccgatctgatcagacgtttctatcaagccgctttaaaagacaaaagcaacgatacaaaaggcgtatatcccgatatccggcccgaaacgatggcttcattaagcgaattgctgcaaacggacattaccgtgcaggacttaatgctggcgcttttgactgaactgaaggaactcagcggacgcctgtatgcagccggattatcgccggaagaggaaatggtatttgaaaaaaatctgacccgaatgctggaacggaatgagaaggtgttcggcacgcaggaaagcttggactaagtccgggcttttttttgtttttggtaattatatactatttagttatagtgaaaaaagaagtgttatatgaaaactagtttacattatataccttatttgattaatatatttatgtaggttccaaataattctataaactaaaggagatggagatatgaactttaaaaaaataaaagaagaaaaaagaatcacgatcccgacacatttgttagccggagatgcggaacaatcaggcaattctttcgcttggagcggctgggtgcttgtagtgccgagccaagaagacaatcaaaacccgaatttgaatttctctgatttagccgctcaaaagtaggataatcactgtttggagcctacacatctgagacgaggcggtgagagtgtgacacaagagtatataacagaaattaagcggggggcactgtcatggattgttaaaaatatccattattttgatatgaatcataaagtagcgaatgatttcaggtggcgccttaaaacatttatagaactcatttttcttaccaattacctgatcagaaatcaggcagatgataaggaagttgctgttttaacggagtttattacagaaaggctccataatgatcagcttgaagaatttattcattttgatccggacggtctcgccggattggctatcgcgggtgaatttcttaccttgactgatcatccgtcacgggcttcggtgatatgggagctggaaaaattcacggcagcacgttttgattgcagccttgctaaaattccctttcggaaaatggatctgaagtacagtctgcaaagagcaggcgtaacctcggaaataacggatttttctgacttatatcactacacagcagctggtcaggatatcccaaatacatatatgacggatcatgatgcgtacagtatcactcatacgattttttatataacagacatgggatgttcttcgcttacggataaagagtatcatctgccgtccttaaaagaaaaggtcctgaaatttctcgggatctatatctgtcttgagaatttagatattaccagtgaattattgatgtgcagctcttttttacatatcgacatggataaggacaaccataaaccgctctatgaagcagcctggaataaaatctatcagggccgaatgaaagaggggaatgtcccgagcatcacctatcaacataaacccggtttgaaaggtgaacagcgaagagaagatgtgtttaaacattgctatcatacaacacttgtcgccgcgggtgccgcgcatgcctgtcttagagcagaaaggaacgattaacttgaatagattagctgaagagacagatcaatttttattatcttttgctgaacaatcgcttccggatcaaaagagcattcagctgtttgccggcttctgcaagtactacaggaagacgagccattcttccgctgtaaaagaacatactgaaaggattgcctccgctttcgttgataagtcatgctgggaagatctgtttcactgtaacacggccattgtcaatgagttgattcatatctatttaacggcaaaagcttataaaaagaagcagggaatggattcggatgatcaggtcatacgtcacggattgcaaaacggctatcttataaaaaaagaatggccttattttaaatacgccgaattcgtcggtttgctgagcgagctgggaatgtcaactgaccatgaaaaagtgcgcttttacaagaattcgatgtttcagcctttgctccatgacgcatggaaaagaacagctgaaaacgagctggagtttgtcgagtactgtcttcttcatttagatcagggagagcatctgcttcatcccggcttgaaggcttccattcaaaaatggcttgtgttttgtctcggcagccgaaaaatgaaacagctgtgcaatatgttatttatccaatcgtgtatcgatccatttttttatggctgtcaagcggctcttcatcatataaataacgagaatccatccattcattgtgctccggctcttctgccggcgattgagattctgaatctggagtgtggaacatgcagatagtcaaggaacattttaatataaaaaaaacagaagaatggctgctgggtttttggaagaacattcagctgcagccggaagaaatggaagcagatgatttcatgcacctgttttgcggtttagcggcatgtcatcattttgaaagcagaaaggatacagaagaagttattctattcctagaccgttatttcggagaaaaaacacacgaatgccatccggtcctgttcgcgtatgcgtatcatgtgtaccgcaggatagatgccgcaaaaagcatcttttttcataacggacttgaacaaatggtccgcggtttacaagaggaactgaaatcagagccgtcctctatgatcctcatggtgttaggagcttattttggggcggtgactccggaagaactgatcgtgttcttagaaaccgggatgaaacgtgaggccgatttgctcatggcaccgggcggcatgcaggaagaacaggcggatgccctttatgccgtcacttatttgcaaatgaaagaattgcagccttttctcacggaatggtacaaaacatcagactttgctttttcaggtttaatgttagccgagtgcagaaagtatcacattgacgccgttgcaaaatacacagccattatgaaatttctccaattcgatgaggcgctttttatacgggaagggcgggaatttctacgctttcagcagcgaagcagcgggagcttcggttatttgaatccattagcgatggaccaaggggcggtcagcggcaaattactggaccgtcagtatttcctgccgtccgctcattatgccgccgcctctctgtctatgctgtaatgtctctcttttgaaagacggaaaaagaaatcaataaacatataagaaagtagatcgctataaccgtcatggaataggggatgtttaacgttgaaatcgcatcacccgcacttttatttacataagcaacgagatttaaatgcggaaagagcgtaaatttataccacgtaaattgggcaagcaaatcagttccgcccaatatactgccggcaaacagcagtaaaatggataagcaaagggagagcgcctggcttttgcacaatactgacaaagtgaacgcaatggtgacaatgcttataattgatatgaaacgcaaaagcagaatgattccggatgctttgattgaactgatggtatacagactgtcatttaaatgagtatagacgagcggatatgaagcattggaaaaaccgaataacacgccgccgatcagcaaacagctcacacagtaaaataagtaaaccatgccggtaaacagaagagacgccagaaatttcgatgttaaaatccgccatcttcggttcgggcttgtagcgataaacttaatcgtcccaagggcaaactctttagaaacaaccccgctgacggttaaaatcgcggtcaagctgacgaaaatctcaagcccgtttgaagtaaccgtgccgaaaaacctccagccgttccattcataagggttgatgttatgctccaaataatagtctttattcttaacatcagcagaataataaacgcctgtcgtttcagcgggtttatcaatttcttcctgttttttttcggcgagaagccgttctttccaattgttatccgaggaagcatctaactcatgattcataataaggccggccagcaaaacgatgagaaacaggaaaaaaagagataaaagtgtgccttttttttgggttatttttatgaattcgttctgcgccagatgaaatatgctcataccgcgtcctcctgatctgtaatcatcatgtatttctcttccaatgacaaagttcttgcagaaacgcgggaaatcagaatctctttctctgccaaagatttaatgacatacgggatggtatcttcttccgcttccaattcaatgatgcggctgtctttttgctgtacttgaagaataccgtcctgctctaatatttctttcgcccttgccggatgatcgaccgtgacggtaaacagctttttctgaccaaggtcatgtctgttcttcatgtcttcaattcctaaaatccgtccctttttaatataggcaaccctatcgcaaatctcctccatttccgacaataaatggcttgataataaaatggaaaccccttgcttcgctaaatcggaaagaatggtgcgcaattctttcattcctttaggatcgaggccgttcatcggttcatccagaattaataatccgggattgtgaagaagagaataagcgagccccaagcgctgtttcatacctaatgagaaatgtttcacttttttgcgggcagcctgctctagcccgacttttgcaagggtattcataaggtcatccgttcgcagcgaggtgctgcgcagtttagtaaaatattttaggttttgcaaagcggtcatattcggatacatatccgggccttcaatgataaccccgatatgtctcataaaatattcaaagtcgctgtccggtctgcctctgaatgaaatggctccttctgtttttttaataagctgtacgatcattctgaaaatagtggtttttcctgagccgttcggccctaaaaggccgaaaatctcgccttttctcacatcgaaagaaattgactgtacaataggggtatgattgattgttttagagacatcttttaatatcagggctggttcagtcatgatatttgcacaccttccttatgatttagggtaaaagccgtcaaaaccgaagaacatgcttccgatcaggccggcaacgattaaaatgagagcaatgctataccacatttttcgattcaatggtttccctccttacaacgctgacattccatttgaaatagcgcaaaaagatgcggaatatcagtttcgaaagatcaaatccggccataaacaccgccatacccgctccaagaaccatacatccgttaaaaatggctgttacaatcggcacttttacgaggagaaagaatgatccggtcatcagcatcaggccgatcgccatcaaacttaacaccgcaacagaggcaaaaagaaacggtgtcagcataaacatgaagttgaacatgcccatccccagcatcaggccgaatgctttgaaaaaggagcgccatgttttctgctcctcggcatcactgatgaaaatatccgcttttaaggcgcgcgcaagtgttttggggtttcctaaattgtcggcgatttgttcatcgctttttccttcagcgccgcccatttggaatatttcgccgatatcggcgagtatctctttttgctcaagttccggcagatcttttatttcccgccggagatgttttaaatattggtctttacacattcattttccctccttaatgatgctgttcactttttcggacaggtcaagccattccgattttaatgtttgatgataaaaggcgccttcttctgttaccttgtaatatttgcgtgacgggccttgatcggaagctgctgtatacgtttttaaatagttgttttttgtaagtcttcgtaatatggggtagatggtgccctccgatacagggaacgtttcacttatgatcttgattaattcataaccatataaatcttcataaagaagcagggacaacacacaaagttccaacgctccttttcgtaattggctactcatttactatcattcccatcatatctaataattgtattctctatacagtgtattgcacagtagctaatcgatcaataattcccaagaaccatttgggatgaggaattgaatctttatgcttatgtgcgggcggggaccgagatgcgcagcccttgcgggaagaaggcctcctgaacaatgtttacattaatatagatcaggatgcgcgtcattgacaaatggcaaaaacccctttttccatgacaaggaaaggggtttttccgttattcggccattttttctaaattgccgttccggtccattttgaaggacggagaggcatgttcgtcgtcttcaaataaaactagttttctggctctgttcataattttcaccaaggtttcgtagtcttcctgaatggttttttgatctttttcaagcttttcgacggccgcttccagctgctcggttttagactgaagttcttggttttcccgttttaaacggtcattttccatttgcagggcggaagtttgctttccgttgccttcatagctcttcagaaattgaatgacgtctgccattgtgagctccgccttttggctcggctgctgaggcgccagcaaatgtgataaactagctaactcttccttgaagctttcatcgacataaggcatatgttcgccggacatgacggcttgccgatcctcttttggcgcttccgtttgaaccgtctcttcggctgcggtttcctgcatgatgtccgcatccggcgcaggcggctgatataatagtttcttcttggccggctggccgtttccgagcgcgcgcatccgctgtttccgctgttttttggcgagctgaagcgctttttcgtattgatggcggacgacggcattccatctgaaaccgcacgctgccgacgttctgtttaatttatcgcctacctcttcaaaggcgttcagctgcgtgcttccttcccggacgtgccggagcacggtttccgcaagcagcaggtcattttcctccgaccaggcgtcctgtctttgttttgtcaatgttctcaacccccaatatctttgatggtattagaatgtccagattggaaaatatttatacaaattggctgaaagaatgagagatacgcagagccttgcaggataagatgaatccttgtacaatgagatgtgatgtgatttttttcgtttttaaaattaagttttaacatagaggaacattgaatgaagggaagcgtacatcatggctaatgaattccgagtgtgtgatgattgccaggccaccaatattaagactttgctgccgcgtttgaaagaagctgacccggatgcaaaagtggaggtcggatgtcagtcatattgcgggcccggacgcaaaaaatcgtttgctttcgtaaacaaccgcccgctgtcggcgccgactgaggacgagctgattgagaaagtgaaaaagaagatcaaaaagtaaatgtgtatttttacgacagcctcgcccgatgggtcaggcttttttgcttcaaaaaatcaatgtcggaaaactggaacaaaacgccggacaaattcaaggatgttttcaaattacagagccgatataatagaatcacggctaaaaaaaagagggaatgacgatggcgtatccaaacggaaaattatcagaagaaaaagtgtttaaagatcccgttcaccgctatgttcatgtgcgggacaagctgatctgggatttgatcggcacccgtgaatttcagcggctgcgccggatcaaacagctcggtacgacgtatttgacgtttcacggcgcggaacacagccgttttaaccattctctcggcgtctatgagatagtcagacgaatggttgatgatgtttttaaagggcgtcctgaatgggatgacaatgaacgcgaactctgtctcagcgccgcgcttttgcacgatttgggacatgggccgttttcgcattcctttgaaaaggtttttcatctggatcatgaagactatacgagggaaatcattctcggcgacaccgaggtgaatcaggttctcagaaaggcgggaccgggatttccgcaggatgttgccgaagtcattgccaaaacatacaaaaacaaacaggtggtcagcttgatttcgagccagattgacgccgacaggatggattaccttcagcgggacgcatactatacgggcgtcagctacggacattttgatatggaacggattttaagggtgatgcgtccgcgagaggaccaaatcgtcattaagcaaagcggcatgcacgccgtcgaagactatattatgagccgctatcaaatgtactggcaggtgtattttcatcccgtgacgagaagcgctgaagtcatattgacgaaaattctccaccgtgcaaagcagctccatgaagaagggtatatcttcactcatgctcccgttcatttttattccatttttgaagggaagctgacgcttgcggattatctgaaacttgatgaagccatcattttatattatttccaggcttgggaagaagaagaggacccgattctgtccgacttgtgccgccgcttcattaaccgccagctgtttcaatatgccgaatttaaccccaatgaggaaatgtcggcttattttgaactgaccgctctgtttaaagaggcgggaattgatcccaattactatttagtggtcgattcttcatcggatctgccgtatgatttttaccggccgggtgaagaggaggagcgtctgccgattcacctgttaacgcagaagggccagatcaaagagctgtccaggcagtccgccattgtcgaatccatttcgggcaaacgccggacggaccataagctctactatccgatggacctcatttgcgacgattcagaaaaccctgaagcaaaattaaaaatccggcagctgctgggactgacatagaaggattttggtaaagaaggaaaaggagatgtcgggaatttgttgaaagaacatgcaaaactgatgaaggtgttctcggattctggagaaatcatcgggcggaaaaagctgcagaaaatcatttatatcgcgaagaaaatgcagtatcctttctacgaaaaatatgattttcatttttacggcccgtattccgaagaactgacgcttcgaattgaagagctgtgcaatcttgggtttctggatgaggtgaaggaaaaaaagggcggctactttcaataccggtactcgctgacggagacgggagccgagtttttacatcatgcggagcttacgatgccggatatgaagaagtacatcgacagcgtcaacagccgctcatcccggtttttggagctggtgtctacgattttgtattttgacggccttgaagctgaggaaaagaaagagaaagtgtttacgataaaaagcaaacagaaatatacggatgaagaatatgatgaggcgcttcactacatagaagagctgaaacacatttgttaaaggcgatggctttcgtcttttttgatgaaaaaaccaggccgcacataaagcgggcctggttttgtttattgtctcaatttgctgtgcttgtacgaatataaaaagtaaacgatcacgccgatgatcagccagacggcaaaataaagccacgttttcagcggcagattgaccattaaaaacaaacagcagataatggccaaaatcggcagtacgggtacaaaaggcactttaaatccccgtggcagatccttatgggtgcggcgcagaatcagcacggacagactgaccatggcgaatgtcaataatgcgccgatgtttgagagatctgacagctctttcagatcaacaaaacccgcgatgcaggcgctgatcagtccgatcagccacgtattaaagatcggcgctcccgatttctttccgacaatggtaaagactttcggcagcattccgtctcttgccatcgcaaaagatatacgggtcgccgcataggtatgggcgagaacgacggccatcagtccgatcaccgcaccggcagcgataacgcccgccaccgcgttttgtccgacagactgcagcacataagacatggcttccggcacattaagctgtgaatacggaaccatccccgtcatgacgagacagacgatgacgtataccaatgtacagatcaccagtgaaccgataataccgatcggcaggttgcgctgcggttttttgacttcttcagccgaagcggaaatcgcgtcaaatccgagaaacgcaaaaaagacggcagaagcccccgtaatgacgcctttgattccaaaaggcataaaaggatgccaattgcccggctttacaaaaaagcttcctgtgatgataaacagcaaaacaattccgatttttacgagaaccattatattattaaaggttttgctctctttggagccgcgtgacagaacgacggcaattaatagagtaatgatgatggcaggaaggttgacgatgcccccctggctcggcacgtgcagcagactgtccggcaaaggcatgccgatttcggctaacagattattaaaataacttgaccagccgcttgccaccgccgacgccgtcaccatataaacggataagagcgtccagcccattaaatggccgacaatttctcccatggtggtataagagtaaatataggcgcttccgtaaaccgggagaacagaagcgatttcggcgtaacataatgctgcaaggctgcagacaacggctgcaatgataaaagaaaagattacggaaggtccggcgtttttcgcggccgtaatgcctgtaagaaccatgacgcccgtcccgatgacggcgccgatgcccagtaaagttaaatcaaatccacccatcgttttggcagtctgcctgtttctgctttgttcaagcagctgggtgatgtcttttttttgtaggatattccgcaacacgcatccctccatccaaaagcaaaagccaagaggggctctttggcttttacccgtgtcacatcttctgtgtaatcgacaatcctgtgttctgtttccccgtctgttccgtttcttttccagtcatattgtctgccgcatccgatcagattatcctttccgtcaaacgcagtcacccttaatgattttacctgaatcatgtctataaaaccagcattgcataaaagggatgggtaaaaaagcaggagataatagtctgtatagggcaggataaaagttgcgggctttccggccgaaattttgactttccccgcgaggtatcagtaaaatgtaataaaaaacaatcaaatgatgatggatgcatcttgaaatggggagtttctgcatggagtacgatatattgcaagcaaatgtactggattacgcgctcacgaaatatttaaagagcacgaaaaagcttgatgaggcgacaattccgaagagtataaacaatatcagaggatttattctcaggattatttaccggcacggcacgtgcacgattaaagatatattgcaggaagttacattatcgccttcagccacgacaaccgctctgaatcatttagaaaaagagggtttcgtggaaaggtcgagaaataacgaagaccgacgcacggtatggatgacgctttccgaatcgggaaaaatggcggccatgcaaatgattgaaaaccggcagatgctcattgacgagctgttcgaagcattgacagaagaagaaaagaatacctttttcagcctcgttgaaaaagtaatgaaataagccggcctgacatagcagcgccggccattatcaaggattactccgtatcgctgatccgtttgccggcgacggcgtaatgatcctttctcatttcatcaatcatgacaatgatcttttcttcggctgcgcctgtcgtttcttttacggcttctgtcactttttcaaccagattccgtttttgttcatctgtgcggccttcaagcattttaacggttacgagcggcatggtgctgatcctcctttatcgtttcctctctttggaagagaggtcacttatagtatactgaatgaaggacaatcttgcattttttaaaaaaggggatttttacatttggacagatttttatattatccgctggagcttatgccctatgtcgtgattacgctgatcgtggcatttacgatgcatgaactggcgcacgcgtatgtcgcgtatcggttcggagacgataccgcggcgagacagggcagattaacgctcaatccgattaaacatcttgatgttttcggaacgattctaattttggtcgcgggtttcggctgggcccgtccggtgccggtgaaccgccgcgcctttaaaagaccgcggctggcgggagtgctggtttccgtcgccgggcctgtaagcaacctgcttcttgcctttatcggtttctttttgctagtgttgatgcatgcttacggaatggagctgctttctgcattcagcatggggcttgaccgctttttctctatttggattcagctgaatctcgcgctgtgtttattcaacctgctgccgcttcctccgcttgacggctaccggattattgaggatctcgtgccgccgcgggtgcgcgccaaaatgactcagtttgagagctacgggattatcgtgtttctcgtgctgtttgtgacaccggtcggctcctatgtcgtgtggccgctgttaagtgaggggagagactggattctcaaggtatttgccattatatttcaaccgcttttgtaggagggtattttcatggaagaaaaaaagaagaaaacaatcggatttaatattattaaaagtgatccgaccgacggacatggcggttttggcgccggggcgctgagccttgacaatatttctccggtatttgtcgatgtggaagagaaggaagccttcgttgacatcggcgccatgcatgcccgcagtgtcgttgaaaaaggcatcaaattcctgccgaacaaagatgaagtgccgaacggaaaaccgtactggctcgtgtgggtcaccatcgacagaaaagaagaaggcccttattacgcgggtgtgacggcttgtgaaatgaccgtggacagaagtatccgcagaggctataagtcattgccggagcatgtgaatttaatggataaatcaatgaagcgctgcattatcgtggacaaaatggacgccagctcaaagcaggtgcttgctgaatttctgcagaagcatgaccaagggctctgggaacgttcatccgatgaattgaaaacaggtctgcttccggaagaaaaataatttgtgaactttttgtgaactttataaatatttgcactattttgcgattgtactgagtaaactgttgatacagaatcaggacatggaaagtcccgagccgaaccaagactcggggtttttcatgtttacgcggaggtttcatcatgttcaccgtctttgaaatcgggccatgggtcattgaagcagatgcggcggaaacgagaaaacaatacgaaaaatcatggcctgatccttgcgattgcgggagctgccggaacttttccgaggcggtgaatctccttcccgccgagaaaacaagattgtttacgcagtttgggattcgtccggctgtctgtcacgacttgggggagcatggaaaggaaaacggcctgcatcattatgcgggcagctatccgattgtcggcaggcttagggaaggctggccgaagtttcatatcgagagggcgggagatatccgcttttcgttttcattgccgagtacaacattttttataccgaagggttttcctgaccctattatccatctcgacttttcactcttgctcccatgggtgcttgaggaagacgcggattaaaagcccggcgcgcaatgcaccgggctcagtcttttttgccgagccacttatcccaccactttttgcgcggagcttctttgcgggcgggggcgtgttccttttcttttttagaaggttccgatccgtagcacacatccgcgggctcagtgcctgcgatgaaatacgtataatgctttgcggcgcagccgggtcccgaagtgtagccggaagcgggatcgatatagacgcccgtgacgcccttcggcggtttaagcgctatttccggttctccttcgagcgccttctccataaagtccgcccaaatcgtcttcgcatagcttttttcttctactgaatcaatcgtgctgcttttgtcatagcctgtccatacaccggcggcaagagccgggttaaagccgatcatccagctgtctgcgctggtcgtgcctgatttaccgccataggttcgggtcagccggtcagaaatggtgcgtcccgtgacggaagtatagccgtttaaatcctgatcaaacatgcccgtcatcatgctcgccgtcacaaaagcggcttttttatcaagcgtctgctgatgtccgcgcggctgttcatacaagacgttgccggcggtatccgtcacttttgtgataaaggaaggggtgatttgttttcccccgtttgcgagcatcgcataggcattaaccatctcaatcgggcgcacgggttcagttccgagcgccagagacggaaggggctttaaatgttcgctgatgccgaattcctttgccgccgacacgagcttattcatgccgagaaagagatgagtcttcacggcataaatgttgtctgataacgcaagcgcctgaagcagcgtaatcggtttattggcatagtagccgttgtaattgcttggagaataagtatttccgttgtcgtcaatctggaactctgtggcttcgcttttcatcagcgtgaccggtgtaaagccgctttgaatcgctttgtagtacaaaagcggcttgatcgtggaagccggctgccgtttcgcctgtgtcgcccggtcaaacgggcttttttcgtagtcacgtccgccgagaagcgcaagcacgcgccctgttgccggatcaatcgcggaaaagccgacctgaatgtcagagccggtacggatcgtatgtgccacagtgttttccgcaatccgctgcatgcgcttatcaagcgtcgtataaacacgcaatccgctcgttgcgagctgttcgcgcgtcatgccgagctttttctcgagttctttcatcgcatcatcgtaaaaataaggcgccgttttcgccgcggttctgtttttcagcggctgataggcaagcggcgttttcttaagcctttccgccttttcttttgagatcattttttggccgatcatcagtcggagaatggtttcctggcgctgtttggccttcttttcgctgacatatggcgaatagccggacgggcctttcggtatgcccgccaagagcacggcttccgcatcgttcagatctttggcgtgtttgccaaaatacaggcgcgaggcggcttcaattccatatgcgccgtggccgtaatatatcgtatttacataaccttctaaaatctcgtttttagaatagttctgttcaaggcggatcgtgtaaaaggcttcattccatttacgtttccatgtcttatcatgctcaaggtagagatttctcgcgtattgctgggtgatggtgcttgcgccctgaaccttggccattgcctttatgtcagccagcgcggcggcggccatccgccggtaatcaaaaccgtggtgattgtaaaagttttgatcctccaccgcaatggcggcctgcaccgctatcggattgatatcttttaaccggacccagtagcgcttttccccgaaatcggtctcacctagctttgagccgtcatttgcataaagaatcgtagactgaggaacccggacggagggggccccctgccatttcgctgcaagaagaacggatgtgaagcagacgccggccagcattccgccgatcagtgtcagaaagatgcaggcgcggatgattttgaatgtgattctgagctgttttccagatactttatccacttttgggaaccccctttttcatgattctattattatgtgaaaaaagggggttttttaaacatatcaaaccggacacttctttactttttcccctccatcctctatactttttccttaggtgaaaatgagattttaaccggaataaaagcgatacagacgcttacaataaatgaaataagccttgaaagggagatgacaattgagcgagctttggtatacggagaagcagacgaagaatttcggcattacattaaaggtgaaacaaacattacatacggaacagacggaatttcagcatctggaaatggtggagacagaagaattcggcaacatgctgttcttagacggaatggtcatgacttctgaaaaagatgaattcgtctatcatgaaatggttgcgcacgtcccgttatttacgcacccgaatccggaaaacgtcctcgttgtcggcggcggagacggcggtgtcatcagagagattctgaagcacccaagcgtaaaaaaagcgacgcttgtcgacattgacggcaaggttattgaatactctaaaaaattccttccgtccattgcgggcaagcttgatgatccgcgcgtcgacgtgagagtcgatgacggtttcatgcacatcgcgaaatcagagaatgagtatgacgtcatcatggttgattcaacagaaccggtcggaccggccgtcaatctgttctcaaaaggcttctatgccggaatttccaaggcgttaaaagaagacggcatcttcgtcgcgcagacggacaacccgtggtttacaccggaactgattacaaacgttcagcgtgacgtgaaagaaatcttcccgatcacccgcctgtatacggctaatatcccgacgtacccgagcggcctgtggacatttacgatcggttctaaaaagtacgatccgcttgaagtggaggacagccgtttctttgacatcgacacgaaatattacacgaaagagcttcacaaagcggcatttgttcttccgaaatttgtgagcgacttaatcaaataaaaacgtacggcgcaggagcgaatcttgcgcttttttacaggaaagcgagggttttatcatgaggtttgatgaagcatattcaggaaaagtatttatcgcaagccgccccgactggaaagaggcggacgccatcctttacggcatgccgatggattggacggtcagctaccgtccgggttcacgattcggcccggggagaatccgcgaggtgtctatcggtctcgaagaatacagcccgtatctcgaccgtgacttagctgatttgaatttctttgacgccggcgacattccgcttccgttcggcaatccgcaaagaagccttgatatgattgaagaatacgtggacagcattttagaaaaaggaaagttcccgctcggcatgggaggggagcaccttgtatcatggcctgtcataaaagccatgtataagaaatttccggaccttgccatcattcattttgacgcgcacaccgaccttcgcacggattatgaaggcgaaccgctttcccactctactccgatccgcaaagcggccgagctcatcgggccgcaaaacgtattttcattcggcatccgctccggaatgaaggaagaatttgaatgggcgaaagaaaacggcatgcacatttctaagtttgaagtgcttgagccgctgaaaaaagtgctgccgcagcttgcgggacgccctgtttatgtcacgatcgatatcgacgttcttgatcccgctcatgcgccgggaacgggcacggttgacgcaggaggcatcacgtctaaagaattactcgcgtccatccatgaaatcgcgcgctcagaagtcaacgtaaaaggcgctgacctcgtagaagtcgcgccggtctatgaccactcagaacaaaccgcaaacacggcaagcaagatgattcgtgaaatgctgcttgggtttgtgaaataaaagaaaatcccccgcttgaaacatgcgggggatttttatattgtatataaactacttagaagttagtaaaagcaacatattattttaccattaatcattgatgttattgataaaaattatataatagggtattatttagtaaatacatctttagaaaggaagttagaatgaaaacagcagtagaaaatgaattggaattaaaaaagattgaaatttcagtaattaaactgataattgctgaaaaacctaataaagagatcgctaagtcattaaactactcgcagcgtaatgtcgaatatatcatagccggtctctgtaaaaagtggaatgtgagtactagagtcggtattgtttcggaagcatataaaaggaactgtatacagtgaacgaaatgaaagaaaaacccctattgagggggtttatttatatatgctaaaaaaacattctatacaggaatgccgtaaaaataaaaactgagattgtcaggtagttcaaatttgttctccatttcagaagaataaacaaaagaaataagtatgcaatattgaacaaatcaaagatagaaaaaatcaaatgattacttgtgaaaaataaactagtatttggatgttctgcgaaaatgtttttgaatgatataagaaaaaacttaattgcgaccgggatgttagaaaacataaatagggaataaaaggttttaatcttaatttgagcgccaagaaaatttataatgagaaataatacaaatccttcaaaaatcaccccgaacattaaaagaaacagtgcggctatcgcaatgatataatctaaatgtttcacttgctcaacaacttgtatagggatgtttttgggaattaaacttttcataaaaggcaatagagaacttaaataaaaagctaacccgataatataaaacaaaaacgaggacaaaaaattaatgtttcgttccttaaatgaggataattcaatttgcataatcttaagaggctccttttataaagataggtgtaataaatgtttctaacatagctgctatcattaaaccgagaaatataataccaatatatttaaaagtgaatttcaaatttattttgaggagtaataaatctaaagttaatttcattcctacagaggctgcaagaagcaataccggcacttcaattattccatggggaataacaagcagtaaaaggtttaaattgtctttgatgtttcctatcgcattccctaaaattaatccattaataattaaaacagcaaccgtgccaagtgacagcgtcaacggtcctaaaaaaacaagcagactcgctactttaatattattaaagaaaatctgaaaaaaatccggacggatatttcgatttagattatttacatttgaagcgggatctgtataaaaatatgctgtaaataaagcaattaaaaataagatcagacagagtatgtacaatttgactaaaacgttctttttaaacaaagtattttcatccattcgtttaagggactgccagggatattgaatttaatgttttatattaagctgctgctgtacttgctgcagccaattgttctaaaacggctaatggcaagcctgcaccaagagatcctaaaacagtaatgatagccaggactgaacccgttgcagtgatagcactgacaatccaactaggagctattattccagctctgtttaaaatatcgatgacatccatgcttaaatgattatgttttatactgaaaagagcgagaacaatgattcctgatgctactaatgtaaaaatcgctttactattttgtgtttttaaaagtagactcattttttcctccaattttttcaatatccccagcaagttaaataataaaatatattggaagctatttgaattgcggatttccgaaaaaatatttaagaggtgaaatccgttaaggtatctgctggcttatttcagtacaaagaaagccggaccatatgtatgatccggctttctttgtactgaaacatttatatttttttttcaagaataatatcaaaataatcggctgccccataacctgaaataggaggagcaaatatttgaaccagcttccatccttgctgcgaatacttttcaataatttctttatagtcttctttaggctttcctttccatcggtttacttctacttttatgaacttatattcgtacattgctgtataatcctccggaagtgtattggaattgttaccttgtttttcgattatgataaacttgaatccataaatagagcgcgcagcctattaaaagtattgggaattgccatcctgtatttccgtttttaaaataatctattaatgaccatatcagtaaagcgacagtataaaaactaaatgctattctggcggctatacccgattggtgtttttgcatctcatccattttcttcataagaaccgctcccttacttttttttggcgttatagttgaatactttatctattcccgtatttaatgcgtgagctatcgaaaaagccagacttaaagttggatcatatttattattttcaattgcattgatggtttgcctggtcacattgcagagcttagccagatcattttgtgaaatatcagctgctgttctaagttttttaatattgttatccactaaaaccctccttaaatatttttgtttttattttaaattttcaaatttatatatatttattttaaataatatatgtatatgtgtcaaatactttttacacatttgaattttaaggtatactttttgtttttgcaaattagttgtttatataaaaaacggcttgcagtttaacctgcaagcctaaaagtaatcatcatttaaatcattccgcgctgagcaacttcaaattgatgtttcggtgcacttgcgatttcggctgaaacaaaaacagtgcttattgccaagcaagtaagtgctaatttatacttcaatttcatacaacttcacacctccttgaatctgctgtcttgtttcttccacctttaaaaaatatgcggaagccttctcgaaattttctctttcatgataatattttgccacatctaaggaaaaatcttcaagatcagcatacatcgatttatctctgagaaagtcaaaacattccatgattgcttcttcatcaggctcaccgacatataaagattctaaaaattcatactcggcgatatatagggaatcttctgcctcctctgcataagatacccctttgtcatgatattgtctggctatggccatatttccgattttataatgtatttgtgtgattaagaaataggcttgcgggagagaagtgatgatgttcccatcttcaaaaacagctattgcccgttttatgtaatcaatggctggtttgtaattttcttggctgttaaaacaaagtccgatattatatagagtccggcccattaattgtggctgctgttctgcctctgccatggcataagcctttttaaaatgctgaattgcttcatcatattgctttaagtcaagaaagttggtagcgaacaatgaatggcactgaagcacccttatattatatgcctcctgcttatgataaattttataagcctgccgggcataatccatagaaaaataagtctgtttcatataatagtaggactctgacatcttaaaataaaattcagctttctcgatacaatctttgacaaaatcaagcttatattcagctttcttaaaaaactgaatcgctgaaagatattcacggcattccagctcatacatcccccggaaaaaattaaaataataatcaagacgtccggtcagccgggcctgctttttatcaatatccgcgagcagatccgatagtctaggctgttcttctatccgctgcgattccagcggttcgaggtattcgagcatcagattatggcggaattccatgagagaatagtatagatgaagatcctgatcatcttccagacctgcaagttcttctttgatttctctccgcaagtactcggcgtccgggatgctgaaccttcgaatgtacatataccattcgttgattttttctccaaccgctgaagatgataaaacactcgccactattccgaatccctcccttccacgttatgtatatgacatattttatcattttcattcggaaggatagcgcaaaaataccgcaatgttttctttcgttaaaaccgcatgtctgcggatatcatttcaaaaatccactattatccccacaatttgtacaagcaaacaaatacaccttcccatattctgttgtatctgcgtgagcagtgtatgtctgaaaaggaagtgaagatatgagaaataacaagctttcctttaaagaaaaagcaggagccgcacaagaagaatgtttatgtttttgcgaggaagaagcaagccgtgaagcgatgtttcaagcgccgattgaattgcctgaggggtttgtcgttgatccggctgaagctgttgcaggcgtgacgtggaatgcagacagcctttcttgtgtcattgaacgctgtttcattgagacggggccagagcctgatgaaatcggtgttcaattcgcagtgcgcctgcagggaactgttacgcttctcgtcagtgtctcaccagtgcgaaatcaatatggacaagggaacgggtctgtttctgtcatccgcaatgcagagattgaccaagtcgtctattattccgatgagcctgatgattgcccggatgtcagtgacattacgatcgagaaccttattgtcgttccgccattctatggcagtcctttatcggtgacgggcacgattgtgcttgtgcccgaaccgggacccgtttatgcgtttacagcgaatccaaacgatcaatcggtttctgtgatagatacaaacactcacaccgttgtgacaaaaattgctcttccgtaccggccgacaggtattgaaataactccggataaaagcgctgtgtttgttttgcacttcaacaataatgtgatttctgtcatcgattatgacactttaacagtgacagcatccatactgctggatcagccgcctggatcggtaaaatgcatcccaaatcatgagtttgcttatgttctcggcgatactgcgatttatgtgattggaattgatacgttaactgtggataggtcgattcctgtggaaggatttgattttgcaattgatcccaatgggttattcgcctatgttcttgattttggtttagtgcaaaaagtggacctattcaccggtgaagtcacaggaacgattgaacgagagcttatcgtatcatccatagaaacaaattggccggagcggtatgcgtatgtcttagaacaagaattcttattcaattatttgacggttattgacttaaatacgtttacgatcagcattacccaagagctggagcctgatggccaatatgtaatgtttacgagtggatcagaggtgtatttacatgacagcttcactggcaatttatatgctgtcagtccgaatggtgcaggcgttataggaaatgttccgcaatcggcaagagactttgcgtttactccgaatggcgaatttctgtatgctgctcattttttagagcagaacatcactgtttacaacacggatgattattctgtggaaactgtgatatctcttggggtttcaccgggagatattgtgatttaaccaactgcatgctgtacatttctaaaaggacgtgaattcatgaaaaagaatgatctgtctgctttacaggaaaattgtttctgtttttgtgatgaggaaattagcagagaagcgccgtttcaagtgccgattgacattcccgaggggttcaccattgattctgccgaagcagctgcgacggttacatggagtactgctcatttattatgtatcagtgagccttgcttaatccagactgggacggaaccagaagatatcggtattcgatatgccgtgagagtaaaagggaccgttacgcttcttgtcagtgtgtcgcctgtacgaaatcaatatggacaaggggacgggtctgtttctgtgattcatactgaagagattgatcaagttgtttattatgcagcgcagtctggccgctgtcctgatttcagtcaaataacggtggaagatcttctcattgtaccgcctttctacggcagtccgcttacggtgaccgggacacttgttttaccgccaccgccagaccctcaatcgtatgtgtttacagccaattcaggagacagcacggtttcggttattgattcagatttaaacactgttgtaaaaacaatccctttttctgacgtgccaactaatctaggcgttactttcgataaagctttcacgtatgtcctccatgggaataccaaccttgtctcagtgctagataataaaacattaaccatcataaataccatcactgttggaggagggccgagaaaggttgaatttgattcaacagatgagttcgcgtacgtgatggccgccggatctatatatatgatcaacatggcctctcaatcggtcattgatgtcattccgatacccggcgctttagactttgctcttgatccgaatggacagtatgtctataccgctaatggaagcagttggtcggttgataaatatgatgtaaatactgggcagttggtagaaagtatcatagatacatttgaatttcccagtttaattgccactccttacgctggaaattttgcgtatgtgttgaatggtgagctgctgccgaaaggggtaacggagatcagtttgtcaccattaagcaggggaggcgacttcaaccgtttatttgaaactctgaggacgattgtattttctcgcgatagcactagggcttattttctagagccatatagtgaaccgtttctcattaataacttatacgtagttaatacggctggacagaggatcattgcaaacgtgtctctgcccggcgcctttgacctcgccgtaacacctgataatcagtacatttatgcagcacagcccggcgacaataccgtaaccgtgtaccgcacgagtgattatacagccatgacggtgattccggttgggactggtccgtcagcgattgcgatgtagcttatttcacaggttgagagaagcagagctgcgataaaaaaatcgtttataaataaatgagccgatctgctggatggcagccaggatgattaaaaacagcagttcacttacagtgaaactgagcatccgccaaaccccggctcctgtcagcgctcccgcatgcccttttttgaacaggctgacatgctggaaaagctgcagcaagtacgtccgcataaaatacaataaatacaaaatcagtaacaccgcgagtcccattgatacggcaaggggcgtgtgaaagcggaaagggacggctttgacgatttcgaacacgcagccgaatatgatgacttggcataatacagcagccatcacgtgtgtttggcggacgtttttatagctgtcacgcagcgctttgacatcgttggcatttctgctgcacaatctatgttgccggaagtcgcagcagcttcgatgagactgtgtgagtttctgaaaagctgctgtcatgttttttacggattgggtgacatagtgatatgattttctcttctcataaggaactgctttttatgaggtttatcttcaaatctaatgagcaatgatggtaagatagaagcagttgaagtttacaagctgaatgattatactattcaagtcaaagtggaatgatgaaaaggacgtgtcaaaatgaagcaagagacaccgataacactccatgtgaagtctgtgatcgaggatgacggaaatgatgaagtcatcgaattccgtactaccggattttactatgtaaaacaacaaaaagtgtatctatcttattatgaagaacacgacctaggcaaagtaaaaacgattgtgaaggtgagcgaaggcgaagtcctgatcatgaggtcaggcgctgttaaaatgaatcagcgtttcataacgggagcttccacaattgcgaaatataaaatgtcatttggtgagcttgagctggaaacaagcacaaaatcgattcaatctgatctcggtgaagaaaaaggccgaatcagcatcgcatatgacatgcatgtcggagacgggcagcagcatttacataatatgacgatcacgtatgagggaggaactcacgcatgaacattgcggaacaaatgaaggacgtgctgaaggaagaaatcaaagcggccgttctgaaagcgggcctggcggacgaaagccagattccaagcgtactgttagaaacgccgaaagaaaaaacacacggtgattattccacaaacatggcgatgcagctggcgagaatcgcaaaaaaagcgccgcgccaaatcgctgaggagatcgtggcatcatttgataaaggcaaagcttccattgaaaagatggatattgcgggacccggctttatcaacttttacatgaacaacagctacttaacaaaactgattccgtccgtgcttgaagcgggtgaacattacggagagacaaacatcggacaaggcgaaaagattcaggtcgaattcgtatcagccaacccgacgggagatcttcacttaggccatgcgcgcggcgcggcggtaggtgacgcgctgtgcagcgtgctttctaaagcgggctatgatgtgagccgcgaatactatattaatgatgcgggcaaccagattaacaacctggcgctttccgttgaagtccgttattttgaagcgctcggtctcgagaaaccgatgccggaagacggctaccgcggcgaggatattatcgccatcgggaaaaagcttgccgaagatttcggcgaccgtttcgtacacgaagaggagagcgaacgtcaggcgtttttccgtgaatacggcttaaagtacgagcttgataaacttcgctccgatctggaaaatttccgcgtgccgtttgacgtatggtattctgaaacgtcactgtatgaaaacggaaaaattgatcaggcgcttgaggcgcttcgcgaaaagggccatgtatacgaagaggacggcgcgacatggttccgctccacaacgttcggcgacgataaagaccgtgtgctgatcaaaaaagacggctcatacacttatttgctgccggatatcgcataccataaagacaaacttgaccgcggattcgacaagctcatcaatgtatggggcgcggatcaccacgggtatattccgcgtatgaaagcggcgattgaagcgctcggttacaagaaaggcacattggaagttgagatcattcagctcgttcatttatacaaaaacggcgaaaaaatgaagatgagcaaacgtacggggaaagccgtaacgatgcgcgacttgattgaagaagtcggcttggatgccgtgcgttatttcttcgcgatgcgcagcgctgatacgcacatggattttgacttggatcttgccgtatccacatctaacgaaaaccctgtgtattatgcacaatacgcacatgcacgtatttgcagcatgcttcgccaaggggaggagcagggacttaaaccggcggcagatcttgatttcagccatattcaatcagaaaaagaatatgacctgctgaaaacgatcggcggcttccctgaggcagtggcagaagcggcggaaaaacgcattcctcaccgtgtcacaaactatatttatgatctggcttccgctctgcacagcttctacaatgcggagaaagtcatcgatccggaaaataaagagaagagccgcgcgcgtctcgctttaatgaaggcgacgcaaattacgctgaacaatgcgcttcagctgatcggcgtatccgctccggaaaaaatgtaatgatgatcaaaggacaaagtcttcgggctttgttctttttttgtatataaagcgtgtgatgtaattcacaatcccgcacactgagtttttgtatgataagactgatattgaatcagtgaaaggggcaagccgaatgatcaatcgtcaacatattcaattatcgttgcagtcattaagcttagtggcagggtttatggtgtgggtgctgatttcatcgctcatttctcaaatgacatcagatattcatttaagcaaaggcgaaatttcattggtgacggcgattcccgttattctcggatcgcttctccgtattcctttaggatatttaacgaacaggtatggggcgcggctgatgtttatgatcagcttcatcctgcttttgtttcctgtattttggatcagtatcgcggattctttatttgatttaatcgcgggcggctttttcttagggatcgggggagcggtattctccatcggagtgacgtccctcccgaaatattatccgaaagaaaagcacggtgtcgtcaatgggatttacggtgccggaaacatcgggaccgccgttactacctttgcggcgccggttatcgctcaagccgcgggatggaaagcaaccgtgcagatgtatcttgttttgctggctgtcttcgcattactgcacgttttgttcggcgaccggcatgagaagaaagtcaaaatttccataaagacacaaatgaaagccgtttaccgaaatcatgtgctgtggatgttgagcctgttttattttattacgttcggcgcctttgtcgcctttaccatctatcttccgaattttttggttgagcattttgggctgagccctgcggacgccggtctgcggacggccggctttattgcggtctctacgctgctcaggcctgtgggagggtttcttgcagataaactgagcccgctccgcattctgatgttcgttttcgcagggcttacgctgtcaggggtcatgctgtcattctccccgacgatcggcctttatgcgttcggatcgctgacggtggcagtctgctcagggattggaaacgggacggtatttaaactggtgcctttctatttttcgaagcaagcggggattgccaacgggattgtgtctgccatgggcggactgggcggttttttccctccgctgattctggcaagtgtatttcaggcaacaggccaatacgcgatcgggtttatggcgctttcagaggtcgcgttagccagctttgttcttgtgatctggatgtattggcaggaaagaatgaaaacacatacggagagaaacagtcagagcctcaattcataatgatccattcacaagattgttagttttttctgggtgagtgcaaatcaagtcacgttacaatatacatacgcaacgtgactttcttcgaggtgagctcatgaatattctctctgtccgaaaatctgataaagaacttctttcccgcgaactgcatgaattgctggaatcgatcagtacgaaaaggaaaatgaaaaaacatacttatttgtttcaagaaggaatggatgcaaaagagctttatctgattcagtcaggactcattgaaatcggcaagctgacgtctgacggaaaagacctgacgcttagaatctgccaaaaaaacgatattgtcggggaattgacgctattcacagatgagccgagatatatgctcagtgcgaaagtgttagaggatggcgaggtgctcgtcattaataaaaacaagctggaaaaggaattgatccaaaacggtgttttgacgtttgaatttatgaaatggatgagcacccatcttcgaaaaatccagtccaagatcagggacctgcttcttcacggcaaaaagggggcactctattccacccttatccgcttatcaaacagctacggggtggaacgaagtgacgggattctgattaacattgtgctgacaaatcaggatttggctaagttttgcgcggcggcaagggagagcgtcaaccgcatgctgggagacctccgcaaacaaggggttatttcgatagacgaaaccggaaaaattattttgcacaagcgggactatttacgatgcgagatcgagtgtgaaaattgtccgctggagatctgcaatattgactgaaaaaaacaagggcagccggtgtccttgtttttcagcttgtgatacatatacacatgacggcgaaaaagaagccggcatttacgatttccagaatgccgatcgttttcaccggccagtctcttccgtgaaaaaaccaggcccgcagactgcttgggataaaagagagaaacgcccagcctgccccgagaagagccgataaaaaggggagcaagaggtgatatccccacgaccagtatgcaaaggttctgctttttctctcccgtatgaccgatttcacataaaaagaactcccgacaaaaaataaagcagattgcaagaatagaaaccaagcccagccgtcaagggttcccgttcccagccagcagctcgcaagcccgcctgaacaaaagaacagaacacccgcaatatcattcgtgagcgcccgttcgttttttcggcgggcataatgcgtatgtatgagaaacagcggcaataaaaaaacgccgatccagacgagctgcggcttatgatagacagaaatgatcaaaaagcagcaggccggaaaaccgtaataccatatccacttttgatagggctgaagctgtttttttttcaaagcgagcgaaacgggataaaccgctaagtaaaggaacagccagcccagaaagagcggaatatgccagaaaaccgggcctcccttgaccatgccgagtaaaaatggaatcagcagcatcgcccatgcgccgtgctgcttcggaatcatcgccttcatcgaaaccctcctttttatttcattataagtacaaacactctcctgataagtgacttttatcatacaagctgtgaaatacatcactgccgcgcgggctcaatcgggctacactaaagctatccttagcacaggaggctttcctatgaatcagtgtgactatttattatttctgaaacaacttcctatgtttaatgaagtgcctctgtccattgtcgaaaccttgctgaaaaacgggacgtttatccgcggctcatctgaccaatctccatcctttcttcattcacaatccgtttatattgtattaaaaggcaatatccgttttacggacagcaggctccctgaagggtcgcaaaccgttgcgctgtgggaaaaaggcgatgtgtttccgattgatgaaaaaggcgggctctctttatcgccttttatctcagtcaatgcctcaccggatattctggtactccatattccatattccgtatttaagcaaatgatgtcttaccatccgcggctgcaaatgaactttttggcgatgcttcagcaaaatgtcttctgttcctatcagttgtttttgcggtatctgcatacatcacgggatgaaaacgccgaacccggttcttaaacagaaccggttttttttgatgacgccgggcgtccccatatcgtttgaaaatccttcctgctgctctgtgtgaacgttttgtgaaaaaagcagagtgtgtgacatagttcacaaggtgatgcgacgtctctgtttatagtgtacatagcatcacctgactcggaaggagtgaacgatcatgaagaaaaagaaaatgagtccgttgctcaggagattaaactatttttctcctatcgaacatcattcaaataaccatagccaaacgacaagcgaagatcgtgattgggagaatgtatacagaaacagatggcagtacgacaaagtcgttcgctccacccacggcgtcaactgcacgggttcttgcagctggaatatttatgtgaaaaacggaattgtcacgtgggaaggacaaaacttgaattatccatcaacaggcccggatatgcctgatttcgaaccgagaggctgtccgcggggggccagtttttcttggtacatctacagcccgctccgtgtgaaatatccatatgtgcgcggtgtgctgatcaatttgtggcgggaagcattgcaggcgcatcataatccgctggatgcctggaaatcgatcgtcgaaaaccctgaaaaagcgaagtcctataaacaggcaagggggaaaggcggctttgtccgcgcggaatggccggaggtgctgaagctgatttcagcctctctgctgtatacagtgatgaaatacgggcctgaccggaatgtcggtttttctccgatcccggcgatgtccatgatcagccacgcatcaggttcgcgattcatgtcgttaatcggcggcccaatgctcagtttctatgactggtatgcggatcttccgccggcgtccccgcaaatttggggcgaccagacggacgttccggagagcagtgattggtacaattcaggctatattatcacatggggctccaacgttccgttaacgagaacgcctgatgcgcattttctggcggaagcccgctataaaggcgctaaagtcatttcgatcagtcccgattttgcggaatcctcaaagttcgcagatgactggctgagtatccgccaggggactgacggggcgcttgcgatggcgatgggtcacgtcattttgcaggaattttacgtgaaccaagaaactgaacgttttattgagtacgcgaagcaatacaccgattttccattcttcgtcactctgtcaaaagagaacggcgtgtatacagcaggacggtttctgcatgcaaaagacatcgggcggcagacaaaaaatgatcagtggaagccggcggtctggaatgaacagacaggtgcgtttgccataccgcaaggcacaatgggctcccgctgggacgggcagcagaaatggaatctgcacatgatcgacgaagacaccggggaacagattgagccccgtctctccgtgctcggaatagaggacgaaatcggctcagtgcgcattccgtatttttcagatgacggaaacaaagtgcttgagcgggatcttcctattaaaaaactggacctgaacggtgaagagacgtacgtcacgaccgtgtttgacttgatattggccaactacggcgtgaaccggggcatcggcggacaatcagccgcatcctatgatgatccccgtccgttcacacctgcctggcaggaacggatcacgggaattaaaagagaagccgttatacagattgccagggagtttgcccaaaatgcgattgatacagacggcagatccatgattatcgtaggggcgggaatcaaccactggttcaactccgacacaatttaccgtgcggtgttaaatcttgttttactcgtaggcgcccaaggcgtaaacggcggaggctgggcccattacgtggggcaggaaaagctccgtccggctgaagggtggcagacgattgcaaccgcaaaggactgggaaggcgtgcctaaacttcaaaacggcacctcgtttttctactttgcgacagaccagtggcgttatgaagaccagccgatcagtgacttggcttcaccgatcaccgcgtcatcccgctacaggcatcacgccgattacaatgtgctggcggcgcgattagggtggcttccgtcttacccgacattcaatcaaaacggcattgatctgtacaaagaagctgagaaagcgggggcggcgacacctgaagacgtaggtgcgtacgtggcctcacggcttcaagagaaaaaactgaaattggcgattgaagaccctgacaatgaagtgaatttcccaaggaatctcttcgtatggcgggcaaatctgatctcaagctcagggaaagggcatgaatattttctcaagcatctgctggggacgacgaacggtctgatgaatgacgacagcgacagcatccgccctgaagaaatcaaatggcgggagcaggcgccggaaggcaagctcgacttgttaatcaatcttgattttcgaatggcgggtacggcgctgtattccgatatcgtgctgccggcggctacatggtatgaaaaacacgatctcagcagtacggatatgcatccgtttattcatccatttgctccggccatctcggcgccgtgggaatcgaagtcagactgggatatttttaaggcgctgtcaaaagccgtttccgatctggcggaagaagtcgatatggagccggtaaaagaggtagtcgcaacgccgcttctccacgacacgatgcaggaattggcccagccattcggcaaaatcaatgactggagcaaaggcgaatgtgaagccattccgggaaaaacgatgccgaacatccatgtcgttgaacgggattacaaacacatttttcataaaatgaccgcgctcggccctcatacggctttaaaaccgagcggaacaaaagggatgagctggtcgattgcggatgaatatgaatcactcaaacagagactgggagaaaccgattcaaacagcgttgccaaaggatgcccgaatataagtgaagcgaagcaggcggcggaagcgattttaaccctgtcgtccacctcaaatggaaaagtcgccgtgaaagcatgggaatcacttgaaaacattaccaatctggagctgaaagacctggcggaagagcgcgaggaagaatgctttacgttcgagcaaattacagcccagccgaaaacggtcatcacctctccggcctttaccggttcagaaaaaggagggcgcaggtactcgccgtttacgacgaatgtggaaaaattaattccgtggcggacgctgacaggcagacaatcctattatgtcgatcatgaactgatgatggaattcggtgaaacgatggcgacatttaaaccgatcctccagcaccgtccgttcctaagcaagcggcctgatcaagagggcaaagaaatcgttcttaattatttgacgccgcataataaatggtccgtccacagcatgtattttgattctctgccgatgctgacgctgttccgcggcgggccgaccgtgtggatgaataaagatgacgcagaggacacggatatcaaagacaacgattggattgaatgcttcaaccgaaacggcgttgtcgtcgcgagagcggttttgtctcaccggattcctaaaggaatggcgtttatgcaccatgcccaggaccgccacatcaatgtgcccggcacaaaactgacgaataaccgcggaggcacccataacagcccgacaaggattcacgtcaagccgacccagatgatcgggggctatgcccagctcagttacggctttaactattacggtccgacggggaatcagcgcgatctgaatgtcgtcatccgcaagctgaaggaggtcgattggcttgaagattaaagcgcagatcgggatggtcatgaatttggataaatgcatcggctgccacacgtgcagcgtcacctgcaaaaacacgtggacaaaccgttccggtgcggaatatatgtattttaataatgtagaaacaaagcccggcatcggctacccgaagcaatgggaggaccaggacaaatataaaggcggctggacgttgaaaaaaggaaagcttgaactgaaatcaggcccgaaaacaaaccggcttgcaggccttttctataatccgaatcagccgacgattgatgactactatgaaccttggaactatgattatgaaacattaacaaacagcccgcaaaaaaagcaccagccggtggcgcggccgaaatcgtccttaacgggggattttatgaatatcgaatggggtccgaactgggaagatgatctcgcgggcggccatattacagggcttgaagatccaaacgtgcaaaaaatggaggaatcgatcaaaacagaattcgatgaagtctttatgatgtatcttccgcgtatttgtgagcactgcattaatccggcgtgcgtgtcctcctgcccgtccggcgccatgtacaaacgcgaggaagacggcattgtgcttgtggatcaaaatgcatgccgttcatggagatattgcgtctcatcctgtccttataaaaaagtctattttaactggcagacgaacaaagcggaaaaatgcacactctgcttcccgcgattggaggcagggctgccgaccatctgctccgaaacgtgtgtgggcagaatccgctatctcggcgtcatgctgtatgatgcggacaaagtggaggaagcggcctctgttgaaaatgaaaaggatctctaccattcccaactggacgtttttcttgatccgaatgatcctgagattgccaaactggcaaaagaacaaggcatcccggctgaatggatagaagcggcgcagcaatcgccgatctataaaatgatcattgactggaagattgcgcttccgcttcaccctgagtaccgtacgctgccgatggtttggtacattccgccgctcagcccgattatgaatctctttgaaggaaaaggcagccggcaaacggcggaagcgatttttccggctatcgaccaaatgagaattccgattgactatttggcgcagctgttaacggcgggggatacggatcatattcggtccacgttaaagaaaatgtctgtcatgcgccagtatatgagggcggttcagacaaataaatccatcgacccggcattggtctccagtgtcggcttaacagaacagcaaattgaagacatgtatcggctgctggcaatcgccaaatatgatgaccgttttgtgatcccgagcagccatcgagaagaagtgtcagatttatatgctgaacaagggagctgcggcttatcattttcaggcggccccggctcctgtttctaatttttcataaatgaggtgtaataacatgaacaccacagaccggcaaatgacgttctccgctctttccgttcttctctcttatccggatgaagagtggagagccgagattcccgattggaaggctcttatccatgacatcaccaatcagcaaatccgggagaaattgctgcactttttagaggcggcagccggcttttctccgcaagcgctgattgaacactatgtgtatacgttcgatttcggaaaaaaaacgaatatgtacgtcacctactttaactcaggcgaacaaagggagcgcggcattgaattgctgcatttaaaaaacacctaccagcaatccggtttcctgccgacagagaaagaactgcctgattacctgccgctgatgctggaattcgccgcggttgcggagattgaagcggcgagaagcgtgtttgagaaatacgtgtctaatgtgagggagctggcttcccgcctcgaaaaaaataacagcatctatgctgagctgctgcacgtgctgcaggccgcactggaaaacatcggtgtacatgaaagcattgaagaaggggctgttcaggcatgagcgggcagatcctgtggggcgttatgccatacattgtattgacgatctttatcggcgggcatatttaccgctatcagcatgaccaattcggctggacggcgaaatcaagcgagctgttagaaaagaaaaaacttgccgctggcagcacactttttcattggggactgctgtgcgttgtcggcggacatgtcatgggaattctgatcccggaaggcgtgtatgcttcccttggcatttcagagcatatgtatcacaaaatggcgatcggcgcaggcctgccggcggggattgctgcatgtgccggacttgtcatcctgacatacagaaggctgtttgacaaaagaatccgcaaaaccagctcgccatcggatatcttgacgcttattctgctgctgttcatgatgctgtcgggcgttgcggccacgtttctcaacatcgattcgaaaggatttgattacagggcaacagtcgggccgtggttcagggaaattgttttgttccggcctgacgcttctttgatggagagtgtcccgctatggtttaagtttcatatcatcatagggtacgccgtttttatcctttggccgtttacaagattggttcacgtgttcagcctgcccctcaagtatttgacccgcagctatgttgtctatcggaaacgcacgtaaaaatcccccctgcaagagggggattttttatggtgaaaaaataaaaacataagatattttctgccaaggtaatggctgggcggcggggattcctgttatgttttatttggaaataacatcaacaaaaggagagtgaagaatgaagcggattttcctcattttagccgcctgtctgatgacaagcgccggcgtcctgacactcagacattctcatgtattaaccggcggcacagcgggactgtcactaagcctgtcatacttgtttcattcctcttttgcgattatcttctttctgatcaatatcccgttttatatattttctctcatcagaatgggaatcaaattcactctatccaccgtttttgcagtcacagtactgactctgtttaccggcgcggatcactggctgccgccggtctctgtttcaccgcttgccggggcgatttgcggcggggcgctgatcgggttcggcctgtcgctcatgttttatcatcaggcatcgctcggcggcgccaatatcctcgctttatttctgcaaaagcgctgcggatggaatccgggtgccgttaatttcctcttcgattttggcgtcgtgctggccggcattttttccgtcgggttgctgaaagggctcttctccttagtgtcgatagcggtcaccggtctgatcatcggcatcttcaaaaataaaatcaaaggcagctgctcgctcaatccggcattgcttcagaacatcacacccggccaatcacaagaagcttcatcataagcctttccgctcgtgcggagaggctttttcatatgtttacaggcctgaaaacagagggtatacagagatatcggatcagatgggagagagtcgggatgctgaaaaggagactggaattttgctttttatatatgatgcttatcggagtatatgtcatatggttttttccggtttccaggcttgagttttacggaggggtgctttgttatgcaagcattattttgttcagcatctattcgttaattcttgaaaaccgcacctcgcagcacacgctgttatggattcatattcttgtgttttttccgatcgccgggtacttattttaccttttttccggccagctttatgaaaaaggcaagctgttcaggtcgaaacggacatacaaccgggaaaagctgagaacgatatttgatatggaacaaactcccgacctgtccgggctgaaaggaaatcagaagcgtttctttcaatattcaatcaaggcgtcccatatgaatattaatacaaaaagcaggctgaaggtgctcaaaaacggggacgaaacatttccggagctgtttgaggcgctccgggaggccgcgtcatttatacatattgagtattacatgttcaaatcagacatgctcgggcacaagatgatggacattatgatggaaaaggcgcgtcaaggcgtggaagtgcggtttttgttcgacgcggccggcagcctgaagctggccggaaaagatattaaaaaactgaaacgcgcgggtgtgaacatcgtcccgtttctgccgctgaaatacggttttttcaaccaaaaattcaatttcagaaatcaccgcaagatcgtcatcgttgacgggaaagtcggttttgtcggcgggctgaatgtcggcaaggagtatatcggcaaagaccaagatgtcggcttttggcgggacacccatatgaaagtcgaaggagaaatcgttcagacgctccacagcatttttatgcttgattgggaatacgtttcggatgaggtgctgattgatcagaaagcatatacccgcccggttgcggcagaaagcggcggcgtctatcaagtcgttccgacaggccccgatatgaaggagcggatgagcgatctgtattatgccatgatagcggcggccgaatcgtctgtatggatcgcgacgccttatttcgtgccgaatgagccgatccgcacagcgctaaaggaggctgctgccagaggcgtccgggtgcgtgtcatggtgccggaaaccaatgacggatttttaacccagtacgcgacgagatcgtatttccccgagcttcttcgcgaaggaatcgaagtctattcttatcaaaaaggctttatgcatcaaaaggtgctcatcactgacggaaacctcgcctctgtcgggacggcgaatatggacatgagaagctttcagctgaactttgaagtcaatgtcttttttacagatcaagaggcgatcaaagatcttgaagcgcattatctggaggatatgaaggagtctgaaaaaatcagccccgtccgtttctataagcgcacattatgggaaagaacgaaggaatccttcgcacggttattttccggcgttttataaaaaacgcttttaaaactccttgtgtatagtataattgagaaatattatcattaagaacgaggcacaaggaggacggaatcgtgctgcgacaatttttttcttattataaaccgtacaaaaagctgttttttctcgacttcttttctgccatcgccggcggattgatggagctgagttttcctctgattgtcaattactttatcgatacattgcttccggggcgggattggagtctgattattttgacttccgctgctttattcggggtctacgccctcagctcggcacttcagtatgttgtgacgtattggggccatatgctcggcattaacattgaaaccgatatgcggaaaaagcttttcgaccatctgcaaaagcttccgttcaaattttacgataacaacaaaacgggcagtttaatgtccaagctcaccaatgatttgatgtatatcggagaaaccgcccaccacggacctgaagacctgtttatcgcgatcatgacgattttgggcgcattcggtgtgatgctgtttattaactggcagctcgcgctgttgacttttatcattatgccggtcgtcatatggcttgctttgtatttcaataaaaaaatgacctctgcgtttacaaaactgaacaaagacgtcggagacttcagcgcgagggttgaaaacaatatcggcggcatccgtcttgttcaggctttcagcaatgaagcgtttgaaacgcagcggtttgacgtgaacaatcagcgtttccgcaaaacaaagctgacgtcttataaaatcatggcgaaaaacggctcgatcagttacatgctgacaagattcgtcacgctgttcgtcttattgtgcggcacatggttcgtgatccgcggatcgttatcttacggggaattcgtcgcttttgtgctgctgacgaacgttctgttccgtccgattgataaaatcaacgcgattattgagatgtatccgagaggcattgccggttttaaaagctttatagaaatactggaaacggagcctgatatcaaggacgccccgaacgcgagacatgtgtccggtttaaaagggaatatccgttatgatggtgtgtcgttcggttacgaagaaaacagtccggttctgtcgggaatcaatttgtccattcatgccggggagacagtcgcattcgtcgggccttcgggagcgggaaaatcaacgctgacaagtctgctgccgcgcttttatgagccgtctgaaggcgtgatttccatcgacggaatcgatattaaggacatgacgctgtcatcattgcgcggacaaatcggcgtcgtccagcaggatgtctttctgttttccggcacattgcgggaaaacattgcttacgggcggctcgacgcgtctgaggaagaaatctggcaggccgtccgccaggcgcatttagaggacttggtaaacgggtatcccgacggtttaaacacggtgatcggcgagcgcggcgtgaaactgtcaggcgggcagaagcagcggctttccatcgccagaatgtttttgaaaaacccgtcgatcttaattttagacgaggctacatcagccctcgatacagaaacggaagccgccattcaaaaatcgctgcaagagctgtctgaaggacgcacgacgcttgtgatcgcccatcggctggctacgattaaggatgcggacaggatcgtcgtcgtcacgaaagaaggcatcgctgaacaaggtcatcataaggaactgctggcatccggcggcatgtaccagagacttcatcaggcccaattcggcgagctgattcattaataaaagaaaaaggatagacgagcgggggccgggcagcctcctgtctatcctttttttatgtagtccgtatttaatgggcttctttttgcgcaggttcgatgatatgtttgaaacggtcaataagctgcaccgctttctttccttccactacaattaaatattcttgttctttatgggccattctgaacgtttccagctcaatgatatctttgatcttgcacattgtttttttagagtagatatacagctcgtggccccccgtgtggcaaagctgataaagctgaagcatgtttcttaaagtgaacttcttagcggctattttcaaagatgtaatgtttttcatatgttttctcctccgtctgatggtctgttatttcggaaattccccatataaacgggtgataaacctggttatgccttccacctcagcactccgcccgccaggcgtttgactccccggatggcgcttaattcttcgacgagccggagcagcgcccggtctttctctttcgcctcaatcataaaatcgatgtccgtatcccattgtcgaaaccgctccagcaccggcagaataaaattcgcatccacatagtccgcatgactgcgtatggctgattctgattttggcgaggagagatggaccttcggctttaagccgatccgctgccatgttttgatcatccgcggaagaatgtcatctaaatcagcgtcatcggtcggattggcgtaaaaatggtgataatcaaacacaaacggaatgccttcttgttcacatacactgagtgtttcctcggacgtatacgttttatcatcgttttctaaagtcatccgctgtttgatgacatcgggaagttctttcagattcacgcggaaacggccaagcgcgctttgtttgtcaccgtaagcgcctccgacatggatgttgatgacggaacggtccgcgatgcccattgcgtccagcatgtcataatgataggccatatccttgaccgcatttgcggtaatctcctgtttcgggcttgtaaaaagcgtgaattggttcggatgaaagctcgttctgagatcatattttctgaccagcccgccgatctcacgaaactcctggcgaaacggcgtgacaaaatcccacagcacatccggatgggtggcgagcggcacaatcgagcttgagaacctgtacagcgggatgccgtggctgatcacatagtggatggtgcgcagcgtattggtaagatttgcttttgtcacagaaagcagggcgtctttccgctcactgcgggaaagcttggtatagcgcgcatatgttaaggtttttgcgggggacgcgtcccaaaggcgcatggcgtttgcgacgaatccgaatctgaacagcatatggtttctcctttataaaaagtaagatatggcctttcccagccattctgcaggaagctgtctgacggagcgctgtttcactttttctaatgtgagaagctcggatttttcgatgtcctgctttatggttgaaagcacttcctttgtaaaggcttcatcatgaatgatgacattcacctcttcattccagaacagactccgtttatcaaaattcggcgtgccgataatgctgatgcggtcatcaataatgaaagctttgacatgataaaagccttgataataccgatagatgaggcagccggccttcagaagctcgggataataggtaaaagctgtttcccgaacgagcgggtggtctgacttcatcggcacgatcaagatgactttgacgccttttcggcaggctgaaataagcgcttcctgaagctttttgctcggtacataataaggcgtgccgataatgatttttttctccgccttacggatgcagttttcataatgcgattcaagcgaaaaaccgtcagacgcatatgtcctatgagagatattcccttcggataatgccggataaaccccgggtgatccgggtgcttttccggtgtttcgtttcagatcgcttacaaaaagagtctgaagatcggccgtgccttcgccggtcatccgcaggtgataatcctcccagtttccgaacttcgcttttttgccgaggtactcttcagcgatattaaaaccgccgacatagccgattttgccgtcaatgacggtcactttccggtgattccgtttttgcagcctgaaaaaaagaaacggaaatgccggtttatttagaaaatgaacgtgaacgccggcttttttcatcgtttgaatggaaggctttttcacttggcggctgcccgcccaatcgagcagcagatatacggagacgccggcctgggccttttccttcaataaatgaaacatctcatggctgacttggtcgttcttcataataaaaaacatcatatgaatagaagagacagcttggcggatatcagccgtcatctgccgcacaagctcgctgccgcagtgaatgagtgtgatatcactctttttcgggtcaaaaacgggctcatacgcctgttttttgtacgccgcccggccaagcagaatatcaagcagcataagtgcgatcaatatgataaaaatgacaagcaacacaaaaatgaccttcataccgacgctcctttccgaagtattcgtagtgtgccctgagaatgtgaatttaattattgactgaacactcattcattatttatgataaagtaaagatatgacaatgaagaggggtatcagaacaaagggggagacaagatgaacgcatttctcatggtaaacgcgctgctgttttcagctgtaaccgcttacgccgtttatttattcgtttacctgatcagaacgaggatcgcttatattaagctcggccaaagggaagaatttgataaacgcctgaaagaacgtcttcagaagatatgggtgaatgtgttcggacaaaaaaaactgctgaaagataaaaagagcggcatcatccacgttctgtttttttacggttttatactcgttcagttcggcgcaattgattttattctgaaagggctgcttcctgaccgtcatctgccgttcggtccgctttatccggcgtttaccttttttcaggaaatcgtcacgtttctgattttaatcgccgtagtctgggcgttttaccggcgctacattgaaaaactcgtcagactgaaacgcgggtttaaagcggggcttgtcctgctgtttatcggcggactgatggtgacggtgcttctcgggaacgccatgaaccttttatggcacgatcattctctgtcttggacggagccgatcgcttcctctattgcgtttgtgctcggcggtctttcagcgccggcggcagccgccgtgttttatgtttcatggtggcttcatctgttgtttttgctcagctttttagtgtacgtgccgcaatcaaagcatgcgcacttaattgcgggtccggcgaatgtgttcctcagcaggctggattcaaaaggaaagctggaaaaaatcgatttcaccgatgagacgaaagaaagctacggcgtcggaaagattgaagacttccgccgctctcagcttgtcgacctttacgcctgcgtcgaatgcggccgctgtacaaatatgtgtccggcctccggtacgggcaagatgctctcgccgatggacctcattttaaagctcagagaccatttgacggaaaaaggcgctgccgtgacgtcaaaatctccgtgggtgcccgcgcccgtttttcagcacacgaaagcgaatcagctcgccgcggcttcctcagggggaggatcgcgtgaagcggccgcagccattgattacaacccgagcttaatcggcgaggtcatcacggaagaggagatttgggcgtgcaccacttgccgcaactgtgaggatcaatgtccggtcatgaatgaacacgttgataaaattatcgatcttcgccgttatcttgtgcttacggaagggaagatggacagcgacgcgcagcgggccatgacaagcattgaaagacagggaaacccgtggggcttaaaccggaaagagcgggagaactggcgggagcaggctgatacagaaattccgacagtgaaagaaatgaaaaaacaagacaaagagttcgactatttgttttgggtcggatcaatgggttcctacgataacaggagccaaaagattgccgtctcatttgcaaagctgcttaatgaagcgggcgtatcctttgcgattctcggcaataaggaaaaaaactcaggcgatacgccgcgccgtttgggcaacgagtttctgttccaagagctggcggaacacaacatcggcgaatttgaaaaacacgggatcaaaaaaatcgtcacgattgatccgcacgcttataatatgttcaaaaatgaatatcctgatttcggattccgggccgaagtctatcatcatactgaattattagccgagcttgtgtcacagggaagactaaaaccgcttcacccggtgaatgaaacgattaccttccatgactcgtgctatttaggaagatacaatgaagtgtatgagccgccgagagcgatcttaaaagccattccgggcgttcaattgaaggaaatggagcgcagccgcgaaaacgggatgtgctgcggcgccgggggagggctcatgtggatggaagaagaaacgggagcgagaatcaacacggcccggactgagcaggcgctttctgtcagtccgacggtcatcagctccggctgtccttactgtctgaccatgctcggtgacggtacgaaagcgaaagaagccgaagacgcgatcggcacttatgatgtcagtgaattgctcgccatgtctgtattcggcgccgaaaaacaagagtctttatagaaagaagcgggccgccggcgcatatgccggcggctttgttttcgcacatcagccgatttatgaagggacggctctaaaatttcttaaattacgctgttaagggtagcatattctgttttaatttgtttataatgagaggtatggtttatgaacaaaacaatacaaattcgttcttattataggatagaaacagatacatataagtaatagaaagggagtgtccgaccttgagtatcaaacaatattctcaggaacagctgaagcagatggctttagttgaaatcgctcacgaaattttctcagaacataaaaaaccggttccgttccaggagctgctgaatgaaatgatctccttgctcggtgttacgaaagaggaactgggtgaccgtatcgcccaattttatacagacctgaacattgacggccgctttattgctctgtcagaccagacgtgggggcttcgcagctggtatccgtacgatcagctggacgaagaaacacagccgactgtaaaagcgaaaaagaaaaaagcgaaaaaagtcgttgaggaagatctcgaccttgatgaattcgaggaagttgacgaagatgacatcgatctcgatgaaatagaagaagatattgaccttgaagcagacagctttgacgacgaagatatcgatgaagaagatgacgacgagcttgagatcgaagacgagatgattgaagaagatgaggaagattatgatgatgaggaagaggatcgcaaagactgattttatatcagcaaaacgatcttgactttcattgtcgaactatgtagtatgtattttgggctcttcaaaaagaagagaattcataagagtgctacgctccctttcaagaaattgaaagggagctttcttattttcatctcccaaattcttttacacatcatttgtttttagtgaaatgattttctataaaacggcacattttaaggaatgtagcgcagaccgaagagaggagcaaacgaaatgacgaaatatatttttgtaaccgggggagttgtatcatcactcggaaaaggaattgtggctgcgtcacttggccgccttttgaaaaacagaggcatgagcgtcaccatccaaaaatttgacccttatatcaacgttgacccgggaacgatgagcccgtaccagcacggtgaggtattcgttaccgatgacggcgctgagactgaccttgacttagggcattatgagcggttcattgacattaatctaaacagattcagcaacgtgacgaccggtaaaatctattctgccgtattgaaaaaagagcgccgcggggactacctcggcggaacggttcaggtcattccgcacatcacaaatgaactgaaagaccgcgtgtaccgtgcaggcaaagaaacaaacgcagatgtagtcattactgagatcggcggaacagtgggagacatcgaatcccttccgttccttgaagccatccgtcaaatgaaaagcgacatcggccacgaaaacgtgatgtacattcactgtacgcttgttccgtacatcaaagcggcgggcgagctgaaaacaaaaccgacgcagcacagcgtaaaagagctgagaagcctcggtattcagcctaatatcatcgtcgtgcgcacggaaatgccgatttctcaagatatgaaagataaaatcgcgctcttctgcgatattgacacgaaagcggtcatcgagtgcgaagatgcggacaacctttactccatcccgcttaaccttcaggagcagggactcgataagcttgtctgcgatcatatgaaattagaatgcaaagacccggatatgacggaatggaaagaccttgtcacgaaagtgaaaaacttgtctaaaaccattacaatcagcctcgtcggtaaatacgtcgagcttcaggacgcttacatttcagtcgttgaatcactgcgccacgccggctatgcgtttgacgctgatgtgaagatcaaatggattaacgccgaagaagtgacagaaagcaatattcaagagctgactagcggcacagacggaatcatcgtgcccggcggtttcggagaccgcggcgtagaagggaaaatcatcgccgccaagtatgcgcgtgagaataaaattccgttcttcggcatctgcctcggtatgcagattgcatccattgaatatgcgcgaaacgtattaggtctggaaggggctcactctgcggagatcgatccgtccactccttatccgatcatcgatcttctgccagaacaaaaagatgtcgaggatctcggaggaacgcttcgtctcggactgtacccttgtaagcttcaggaagacacgaaagccttcgaagcgtatgcggatgaagtggtatacgaacgccaccgccaccgttatgaattcaacaacgaatacagacagcaaatggaagagaacggttttgtgttctcaggcacaagccctgacggccgtcttgtggaaatcatcgagctgaaagaccatccttggtatgtcgcttgccagttccaccctgagttcaaatcaagaccgacaagacctcagcctttattcaaagactttatcggcgcttccgtacaagctgcagaacagaagtaataaaaaaagacttgcctcctttaaaagtggcaagtcttttttctgcatcaggcatattcctgcatcatttcctttaacgtaaaggacagtgcgtgatagacatacaggcctgtcattaatgaaggaaagccgtatcttgtcccgtcttcatcaggcagaagcggcatttttaatttgctgtcaatatgaacatcacaaaattcctcaatcccggtttgatctttgatgacaggagatacgccaacgaggccgatccctttttcataaagcttttgagccagcgcctgttcttcagccgtgcccggacctgaacaaaacatcagcaccctgtcgctttctgtaatcgaatcagctgtatccggaaacgctttgacggaaggcatcggttctgagccgagttccgcctcgcacaaaatgccctgcatctcatttgcgccgtataaataaatggtatggccgctgacggctgcctgcgccagcaggcgcgcgccgtcttctattgcttcggattccttatcctgaatgcgggaaaaaatgcctgcaagctgcgtcgtaaatatctttaacatgagtgaaacctcctttacacatacaagaacagtatacaacaaaagagaaaatgctcagaaaatgtcggaaagtagactattataattaaaggaaatgtgaaaatcaaacagaatacataaacaactgcttccttttgacgaaaatgataatattggggtgtaaaatgatgaatgaaaagattttaatcgtagatgaccaatacggtatacgcatattgctcaatgaagtgtttcataaagaagggtaccagacgtttcaggccgccaacggcatacaggcgctggacatcgtaacgaaagaacggcccgatctcgtgcttttagatatgaaaatccccggcatggacggaatcgaaattctcaagcgcatgaagatgatcgacgaatccatccgcgtcattatcatgaccgcttacggagaactcgatatgattaaggaatcaaaagagctcggagcgctgactcattttgcgaaaccttttgacattgatgagatcagagacgcggtgaaaaaatatttacctctaaaatcgaattaataaaattagaaacaattatgtcattgtgttgccgatttgtcgaaaagttggtatcctagagatggagaaaaagcgatctgttgttttacatatgacaggtttttatggtcatgctataggtggaaagcttttttcgagaagaagcaaatcaggctatataaggaggactttcgacatgcctttagtttcaatgacggaaatgttgaatacagctaaagaaaaaggatatgctgttggacaatttaacttaaataaccttgagttcactcaagctattttacaagcagcagaagaggaaaaatccccggttattcttggtgtttcagaaggcgcgggacgctacatgggcggcttcaaaacagtggttgccatggttaaagctcttatggaagaatacaaagtgacagttcctgtcgccattcacttagaccacggttcaagctttgaatcttgtgcgaaagcgattcatgcaggcttcacttctgtaatgatcgacgcatctcaccacccgtttgaggaaaacgtagcaactacagctaaagtggttgagcttgctcatttccacggcgtttcagttgaagctgagcttggaactgtaggcggacaggaagatgacgtgatcgctgaaggcgtcatctatgctgaccctaaagagtgtcaagaacttgtagagcgcactggcatcgactgccttgcacctgcactgggttctgttcacggcccttacaaaggcgaaccgaacctcggcttcaaagaaatggaagatatcggaaaatcaaccggccttccattagtacttcacggcggtacaggaattccgactgccgacattaaaaaatcaatctcacttggtacggctaaaatcaacgtaaacactgaaaaccaaatttcttctgcaaaagctgtccgcgaaacattggcagctaagccgaacgaatacgatcctcgtaaatatcttggacctgctcgtgaagcgatcaaagaaacggttatcggcaaaatgcgtgagttcggttcttcaaaccaagcttaatccaatgtaacatccataaaccgcctgacagcattgacaggcggttttatgtcttacctttagaaagcgcaatcatgttttacagttctgaaaatttattactggggaggctttccttatgttatttttcattgatacagcaaacattgacgagattaaagaagcttatgaacttggcgttcttgccggagttacgacaaaccctagtttagtggcgaaagaagctgacgtgtctttccatgacagacttcgtgagattacggaagtcgtgagcggatcagtaagcgcggaagtcatttccctgaatgctgaagagatgattgaagaaggtaaagaacttgcgaaaatcgcaccgaatatcacggtgaaaatcccgatgacgtctgaagggttaaaagccgtaaaagcgctgagcgacctgaacattaaaaccaacgtaacgctcattttcagcgccaaccaagcgcttttggcggcaagagccggggcgacttatgtatctccgttcttaggccgtctggatgacatcggccataacggtcttgaactgatttcagaaataagacagatttttgacattcatgacattgatacacaaatcatcgcagcttccatccgtcatgcgcagcacgtgactgaagccgctttacgcggtgcgcatatcggtacgatgccgctgaaagtcattcaccagctggcgaaacatccgttaacggataaaggcatcgagcaattcttggcagactggaataaataagggtgaaaagggcggcaaaccggttgcatccgtttgccgcacccttatgttttcctgtttggcagcgggccttcagtatcaaagtgaagagtgtgtttccccggaatgtgaacccggcgggcctctgtgcatcctgtgttaaaaatgccccgcaaagcttcgctattttcttcctgttattttataatgtccttgtattctttctcttcgaattggctacattttggacaagagctttatttgcagagacagaataaaatgccattttatttacgctccgcagctatcttcttatggaaggagactatcatggaaaagttgaatattgccggcggcgatccgttaaacggaaccgtacatatcagcggcgcgaaaaacagcgccgtcgcattgatacccgcaaccattctggcaaattccgaagtaacgatcgaagggcttccggagatctcagatattgaaacgctgcgtgacctgctgaaagaaatcggcggaaacgtccattttgaaaaaggagaaatggtcgtcgacccttccccgatgatcagcatgccgcttcccaacggcaaagtgaaaaaactccgcgcttcctattacttaatgggcgcgatgctgggccgcttcaaacaggcggtcatcggactgccgggcggatgccatctcgggccgcggccgattgaccagcacatcaaagggtttgaagcgcttggggcggaagtcaccaatgaacaaggcgcgatttatctgcgcgccgaaaggctgagaggcgcacggatttatttagatgtcgtcagcgtcggagcgacgatcaatatcatgcttgccgctgtactggctgaaggtaaaaccgtgatagaaaacgccgccaaggaacctgagattattgatgttgccacattgctcaccagcatgggcgcaaagatcaaaggcgcgggaaccaatgtaatcagaattgacggcgtaaaagagctgcacggatgcaggcatacgatcattccggacagaattgaggcgggcacctttatgatcgccggcgccgcgatggggaaagaagtcattattgataatgtcataccgactcacctggagtctttaacggcgaagctcagggaaatgggttttcacattgagacgagtgacgatcagcttcttatgctcggcgggcagaagcagataaaaccggtcgacgtaaaaacgcttgtttacccgggattcccgactgatcttcagcagccgatgacatctctgttaacgagagccagcggcacgagcgtcgtaaccgacaccatctactcggcccgatttaaacatatagatgagctgagacggatgggggccaacatgaaagtggaaggcaggtcggccattatcaccggtccggccgagcttcagggcgcaaaagtaaaggcgagcgatctgcgtgcaggcgcttgtctggtcgtcgccgggctcatggctgacggcgtaaccgaaattaccggtctcgagcatttagaccgcggctacagcaatcttgagaaaaaacttgaaggtctgggcgccacaatctggcggcaaaggctgacggacgaagagatagaacagctccaaaattcatagaaatgcggacttttgagaggagatcgtgttgaaatggaaagaagcttatcgatggaattggttcgagtcactgaagcggcggctttagcatctgccagatggatgggccgcgggaaaaaagatgaagctgatgatgcggcgacaagcgcaatgcgtgacgtgtttgacacggtgccgatgaaaggcacggtcgtgatcggggaaggcgagatggatgaagcgccgatgctttacatcggcgaaaagctcggaaacggatacggccctcgcgtcgatgtcgccgtcgatcctcttgaaggcacaaacatcgtagcgagcggcggctggaatgcgctgacggtgatcgcggtcgccgaccatggaacactgctgaacgccccggatatgtatatggaaaaaatcgcggtcggtcctgaagcggtaggctgcatcgatattgaagcgcctgtcattgataacttaaaagccgttgcgaaagcgaaaaacaaagacattgaagatgtcgtggcaaccattttaaatcgtgacagacacgaaaaaatcatctctgaattgcgtgaggcgggcgccagaatcaaactgatcaacgacggtgatgtcgcgggcgccatcaatacggcctttgaccatacgggagtagacattctcttcggttcaggcggggctcctgaaggcgtgctgtctgccgttgcgttaaaagcgctcggcggcgaaatcatcggcaggcttctgccgcaaagtgcggaagagcaggcccgctgtgagcgaatgggccttgatgtatccaaagtgctccggatggaggaccttgtgagaggggatgacgccatttttgccgcaacgggcgtcacggacggagagctgctgaaaggcgttcagttcaaaggctccgtcggcacgactgaaagtctggtcatccgggcgaaatcaggaacggtccgattcgttgacggaagacacagcctgaagaaaaaaccaaatcttgtgatccggccataaatagagaaaagcgggacggaaagtcccgcttttcttttgcaataaagagtcaaccctatcatttatatgtcaaagcattatttaagttgaataattttttgaaatgaggtaaaaataaagagtgctgcgatttttctgtgtcattccttcttttgagtactgggaaattttcaaattctaccgcatacagacgatataaatattgatcttctcaagtttttgtcctcgcttccttcaaaactcattaagacattccttttttaaaaaagcgccgatcatgggtggaagtgttaccgatagaagttcctgaacgttttataaaagaatgtgctttggcggaatcatgcgaagcagccgatttgaatgaaaacagcaatacattgactatgaaaagcgtggtgtttttatgaaagacgtatctatttcctctttggaaaatatgaaattaaaagaactatatgaactggccagacattataaaatctcctactacagcaaactgactaaaaaagaattaatctttgccattctgaaagccaacgccgagcaggaggatcttctgtttatggaaggcgtgctcgaaatcatccaatcggaaggattcggcttcctcagaccgattaattactcgccaagctcagaagacatctacatttctgcttcccagatccgccgctttgatttaagaaacggtgacaaagtatccggcaaggtgcgtccgccgaaagaaaacgaacgctattacggacttttgcacgttgaagcggtaaatggagacgatccggaatctgcgaaggaccgcgtccattttcctgcgctgactccgctttatccggaccgccaaatggtgcttgagacgaaaccgaattatctctcaacaagaattctcgatatgatggctcccgtcggtttcggccagcgcggtctgatcgtggcgccgccgaaagccggtaaaaccatgctgttgaaagaaatcgctaacagcattacgacaaatcagcctgacgctgaattgatcgttctcttaattgatgaaagaccggaagaagtaacggatattgaacgttccgtagcgggcgatgtcgtcagctcgacgttcgatgaagtgccggaaaatcacattaaggtagcggagcttgtgcttgaacgggcgatgcgtctcgttgaacacaaaaaagacgttatcattctgatggacagcattacccgcctggcacgggcctacaacctcgttatcccgccaagcggacgtacgctttccggcgggattgacccggctgcgttccatcgtcccaagcgctttttcggtgccgcgagaaacattgaagagggcggcagtctgaccattttggcgacggcgctcgtagacacgggctcccggatggatgacgtcatctatgaagagtttaaaggaacgggcaacatggagcttcaccttgaccgttctcttgcggaaagacggattttcccggcgatcgatatccgccgctccggcacacggaaggaagagctgctcgtgccgaaagagcatcttgaccgtctatgggcgatccgcaaatcgatgtctgattctccggacttcgcagagaagtttatgagaaaaatgaaaaaaacaaaaacgaatcaggaattcttcgatctgatcaaccaagaatggaagcaggcaaacctttcatcatcagcccgccgctgataaaaaatgtatttgcaaatgcagtaaatgactgatataattctctcatatgcgttccggattactccggaataataactctgtttccacacgggattcagggcggaaggagatggatacaatgaaagcaggaattcatcctaatttcaaaaaagcaacagttaaatgcgcttgcggaaatgaatttgaaacaggctcagtaaaagaagaggtacgcgttgagatttgctctgaatgccacccattctacactggacgtcaaaaattcgcttctgctgatggtcgtgttgatcgctttaacaaaaaatacggtcttaagtaataatagattttacaggcaggcaagaattgcttcttgcctgttttttatgtccataaacaggaaaaaaaggggagcggatagcctatgtacataatgaagcaaagcggatggcttgagctgatatgcggcagcatgttctctgggaaatcagaagagctgatccgcagagtgaaaagagcgacatatgcgaagcaggaggtcaaggtattcaaacctgccattgataatcgctacagtgaggaggccgtcgtttctcacaacggtacatccatgacaagccacgtcatctcgtcttcggctgaaatatgggatcatatcagtgaaagcacggacgtcatcgcggtagatgaggtgcagtttttcggcgaatcgatcatcggcgacttatcctcgcttgcggataaaggctatcgtgtcatcgcggccggacttgatatggatttccggggagagcctttcggcgtggtgccgaatctgatggcggttgccgaatcggtgacgaagctgcaggcggtctgctccgtttgcgggtcgccggcaagccgtacgcagcgtttgattgacgggaagcccgcttcctatgatgatccggtcattttagtcggcgcgtcggagtcatacgaagcgagatgcagacatcatcacgaagtgccgaaaaaaacagactgataaataacccttttcatgaaaacatcggtaaaaactccggtgtttttttgacgttttttcaaaaattgtagttaaataacttaaaaaagagtatgaaaaaattaagtaattttcatctcttgaattttcatttttacaggcataaaatgactaagtaatgtaaatagttatgagacattgttcgaataattgtcaaaaaaagatatagcagatcgcgatcacactagccaaaatgggtaattacttaactttgttaactatttgaagaaagaaggagattttcttgaataatattaaagtaacgaaggaaggcaacttagaaactactttaagaggaaaagaagttctatctatccctactttaaataaaggtgttgcgttttcagcagaagaaagaaaaagccttggattagacgggctgcttcctccgacaattctgtctcttgatgagcaggcaaaacgcgcatacgagcagtttcaagctcagccggaccgccttcgccaaaacgtgtatttgaatgatttgcaaaaccgtaacgaagttcttttctttaaattgcttcaaaaccatcttcgtgaaatgctgccggttgtttacacaccgactgtcggtgaagcgattcaagaatacagccatgagtacagaagacctcaagggatttacctttctatcgacaacgtggaagggattgaagaggcatttgaaaaccttcatgccactgccggagatattgatctgatcgttgcgacagactcagaaagcatcctcggaatcggtgactggggtgtaggcggtatcaacatcgccatcggtaaattagcggtatacacagctgccgccggtattgacccaagccgtgttattcctgtcgttcttgacgtcggtacgaacaatgaaaaacttctgaacgatcctttatacatcggtaaccgccatgaacgtatccaaggcgaacgttacgaagctttcgttgacgcttatgtaaaagctgcgcttaaatatttccctaaagctcttcttcactgggaagaccttggaaacaaaaacgcgcgcaatatcatgaagaaatacaaccatgaaattcttacattcaacgatgacattcaaggaacaggcgcgattacgcttgcaggtgtgcttgcggctatgaagaaaacaggcgcgtctattaaagaccagcgtgtggttgtcttcggtgcgggatctgccggaatcggaatcgctgaccaaatccgcgacactatggtgcttgccggtctttctgaagaagaagccaacaaagcgttctacacaatggactacagaggcttgttaattgaaggtatggaaaacattcttgatttccaagagccgtacctgcgcacagctgaagaaattaaagattggaaacgcgatgaaaacggacaaattcctttcattgaagtgatccgtcaagcgaaaccgacaatcttaatcggtacatcaggccaaagcggcgcgttcagtgaagaaatcgtcaaagaaatggcaaaacacgttgagcgtccggtcatcatgccgatgtctaacccgacaccgcttgctgaagccgttcctagcgatcttttcaaatggactgacggcaaagtgcttgtggcgacaggaagcccgtttgacaatgtagagtacaatggcgtttctcatgaaatcggacaatctaacaacgcattcgcgttccctggacttggtctcggttcaatcgttgtagaagcgaaagtgattactcctgcaatgtttgcggcaactgctgacgcaatcgcagaaagcgttgattttgaaacaccgggtgcaggccttctgccgagcatgagcgacttacaagaagtttcaattaaagttgcgatcgccgtagcggaaactgccattaaagaaggcgtggcaaaccgcattcctgaaaatgtagaacaagccgttcttgatgcaatgtggaaaccgcaatataaacaagttgtcgctaaataatttttacgattaattttacagtccgagggaaagcttttatgtaaaggctaaagtatacggacattaaggatttggaggagaacattttgagcttcttagatattttaatcctcctggcgccgatctttttcgtgatcgtgctgggatggttcgcaggtcgcttcggaagttatgacgcgaagtcagcaaaaggggtaagcaccttagttacgaagtacgcgcttccggcgcattttatcgctagtattttaaccacttcaagaagtgcgtttttatcacaggttcctttgatggtcgctttgatcattgggattgtcggattctttatcgtcattctgttggtttgcaaatttatctttaagtatgatttaacgaattcatctgtattttctttaaactctgcacagccgacttttgcttttatgggtattcccgtactaggaagcttattcggagcaagcgaagtagcgattcctatcgccgttacgggtatcgtggttaacgccatccttgacccgcttgcgatcattatcgctactgtcggtgagtcatctaagaaaaaagacactgaaaacgagaacttctggaaaatgactggtaagtctattcttcacggtctttccgaaccgcttgcggctgcaccgcttatcagtatcattctggtactctgcggtgtaacactccctggcttgggagaaaaaatgcttgatcagctcggaagcacaacatcaggtgttgcgctcttcgccgtcggtgtaactgtcggtatccgcaacattaagctcagtctgccggctttcggtatcgctttgttaaaagttgccgttcagcctgcgctgatgtacttgatcgctcttgcagtcggacttccggctgaccagatcactaaagcggtattgctcgttgcattccctggatctgcggtagcggcgatgattgccacacgtttcgaaaaacaagaggaagaaactgcgtccgcgttcgtgatcagtgcgattttatctctcatctcactgccgatcatcattgcgctgactgcataatgaaaagctccctgtttcagggagcttttttgattagaattgaaatttaaaaggcgaaaatctcgttttttttctgggtttcttatgttctgaagaagcggctgtttctgagaggggagctgtctgggcaagttcctggatgcgggaggccaatgtctgcaattcggtattgaggtcgtcaatttcccgcctgtgctgaagaagctgataagacaccccttcatccgccttttgtttcagctggcgttcaagctcctctatccttgaaagcagatggttctcaccttgtttctctttcgtgagaatgtccagtttgcgctccagctctgccaatctttgttcagcgccgccattgattttcggacgctgcaaaatgaagcccgtccgttttttcggctgccggggcacttgaacgtccagaagggcagtgccttcagaaatttgccgtttgaccgatttcagcacatcaagatcctcaggtgtaaaggaataatgtccgagctcattccgttcagccggaagattcagctgtttgacccacctttgcaccgtttttgcggagacgccgagctctttcgcggccatgtttgtattcatgatcacatacctcctttttgctaggtattcgaccatgaggcggcgttcccttcatgttagacaaaacaagaaggaattcgccaaagaaagcggcatttcttcaaaaaacttacgcttcatacaattcaagcggaagcttgtcgggatcaaagaaaaaggtaaaccgtttccccgtcagcggatcggttctgattggttctgtgccgacgcccttttcctttaactctctgacggctgcttcaagatcgtttacggtgaaagcgagatgccggagacccgcggcttccggtctggtcggccgttcgggcggatcgggaaaggaaaacaattcaatcgcgtacgcgccgtccagcgcaagatcaagtttataagattcccgttcctttcggtatgtttcttttataatgccgaagccgagaatctcggtgtaaaaagctttcgacttttcataatcagagcatatgattgctatatggtggatggatttcagcatatccgctcctccttttttgcttcagtataacagaggcgaattgcttttgactggcgataagccctatactataatgagaatgttacgcacaggaaaacagaggtgaagaccgtgttagaccgtttacagtcaattgaacaacgatacgaaaaattaaatgagcttttaagtgatccggaagtggtcaacgatccgaaaaagcttagagaatattcgaaagagcaatctgatatacaagaaaccgttgaagtctatagacaatacagagacgcatcagaacagcttgccgatgcgaaagcgatgcttgaggaaaagcttgatgccgatatgagagaaatggtgaaggaagaaatctccgaactgcagggagagacggaaaccttatcagagcgtttgaaagtgctcctcatcccgaaagacccgaacgatgataaaaacgtaatcatggagatccgcggagcagcgggaggagaagaagccgcgctgtttgcgggaaatctctacagaatgtactcccgttacgccgaaatccaaggctggaagactgaagtcatggaagcaaacgtgaccggaacgggcggttataaagaaatcatctttatgattacgggaaaaggcgcatactccaagctgaagtatgaaaatggcgcgcaccgcgtacagcgtgttccggaaacggaatcaggcggccgtattcatacatccacggcgacggtggcgtgtcttcctgaagcggaagaagtagaagtggacattcacgaaaaagacatccgcgtcgatacattcgcatcaagcggaccgggcggacaaagcgtaaacacgacgatgtcggccgtacgcctgacgcatttaccgaccggtgtcgtcgtttcctgtcaggatgaaaaatctcagattaaaaacaaagaaaaagcgatgaaggtgctccgcgccagaatctatgacaaattccagcaggaagctcaggctgaatatgatcagacccgtaaatcagccgtcggttcaggcgaccgttccgagcgtatccgcacatacaatttcccgcaaaaccgtgtgacggatcaccgcatcggcctgacgattcaaaagctggatcaaatcctggaaggcaagcttgacgaagtggttgaagcgttaatcgtagaagaccagtcaagcaagctccagcaggcggaaaattaagatgaagaccgtttttgaagccctaagctgggcttcttcttatttaaccgaagcgggaagagaaaaaaacgcggccgagctgctgttgttaaatgataccggaatggaccggagcaagcttctcgcaagtctgcaggaggccgtcggcgaggacgagctttatcgattcaggcggcacgtggagatgcataaagaaggtattccgattcaatatattatcgggaaagaacagttttacggcagggaattttttgtgaatgacgatgttctcattccgcgtccggaaacggaagaagtcgtctttcatctgctggacagacagaagcgggcattttccgaggcagaacgactgaacgtcattgatatcggtacggggagcggagccattgcggtgacgctcgcgctggaatgcggacatttttcagtatcggcttcggatatttcaaaagaagcgctgcaggtggcggaaagaaatgcgcaaaacctcggagcggacgtctgttttttgcagggagatctgttaactccttttatttcatcagggaaaaaagcggatattattgtttccaatccgccgtatatttctgaagaagaaatggcggatttgtcggatatcgtccgtttccatgagccgcttcatgctcttacggacggcggtgacggtttgaaattctacaagcggtttatggaggagctgcctcttgtcatgaaagataaagcgcttgtcgtctttgaaatcggatataatcaggggaaagccgtgaaagacctgttccgtcattcctttccgaatgcggaagtggaagtcgtacaggacatcaacggaaaagacagaaccgtatccgcggtcatcacatcatgaaaaaagcccgccggtgacgcacacggcgggcttttgttacaatggaaagaaaatgaaaggggcatccgccttgaaaaaagcgttcgccttcggatgtatactcgccgccgcagcttatgcggcgggggttgttctgccgtttggtgttgacatcattttcggcgccgttacggctgttcttatcgtcacagcgattatcgtttccgggttggccgtaagcggagcggagcagcgggccaattatcattctgaaacagaagaaggacggcacgcccgtttaaagatggccgccgttttcttttgcgccgctctcccttcagccggctgtctgctgattacgcttctgtagccggattttgtctttgcagcaatacggaatcccatacccaatagacgacggctgttaaaaccgcaaagatataaaaggctgaattagaaaacagagattggcctgacggctgcaaaagaccgaagatgatcccgtttgcaatgaatgacacccctaaataataaagaaaatacagcggatgaaatctcttcggctttttattcagaaagtattgaagcggcagcgcaaaaatcaaataaggaaacaaaaaataaaacgccatcgaaatgaaagccgcgataatgaattgatgaacatacaaaatagaataaatgacagacatacatgccgccgacagcagcacggtgtaattatatttcatctgaaaacctcctatcaaaataatatcgtaccatattttgaatctgtcaatgcagattatcagcttgctagatttttttcttcccgccggtttaaaccttttccgtcatgtccataatgggactagataaaaaaagcacggagaggaacggtggggaccgatgaaacagacaatgatgatctgcatatatatttttcttttattatcaggagcgcttgcgggtttgacaaaagaagaaacggcgcgggcatcagccgatgagcccgtcgtcataccggatgaagcgatccggctcagaattttggccaacagtgataacgatgaagatcaaaagctcaagcgccagatcagagatgctgtaaacaagcaaatcacggactgggtgaaagatatcacttccattgaagaagcgcggcggctcattcgttcgaagcttcctgaaattaaagaaatcgccaaacaaacgatgaaagaaaagggtgcgcatcagtccgtttcagttcaattcaataaaatctcgtttccgacaaagctctacggcaatatggtctatccggccggaaaatatgaagcgattttaattacactcggcaatggcgagggcgccaactggtggtgcgtcttgtttccgccgctgtgcttccttgatttctcaaacggcgaagcggtgaaagatcaggaagacggcggacagaagcaggaagaaacgcagaaacagactaaaaaagtgctggatgacgtaaaagcaaaggctgataaagcgaagaaagaaaataaagatgacgatgatacagaagtgaagtttttcctcgtcgattggatttcagatctattttcctgaagtaaaaggcataaatccggattcgattcatagattggaagaaagagttgatcgaaacggagggaaatatatgttttatcagctgagagtggcaagagatcaagatacggaggcgctggaggcctttttgaaaaaggctgatacggcacatgcggaaatcgatcagcagatcagccggtttatcgtactggaagacagcgaaaaaatgattgccgcctgtctcgggatcgaaaaattcagcggcggaaaagggcttctccgttcactcgtcatgtcggacaggctgaatcaaagccatatcgttacactgtttcaaagtatggatgtgctgtgcaaaaaacatgagattcaagatgtctacttagtcgccaatcagccctcatctgctgagtttctgaatgtgatgggatttgaagcgtgcgccgatgcgcctgatgaactgtatacgtccgaacatttccgcaactcgttatgcacagaaggttcgtttttaatggtgaaaacctctgcctgatctaacttatacacaaggttatccacttattaaaaagtgttgtccacagtttgtggataacacttgttttattaaaggacatcttttatactttcaaaaggaatacacgagagaaaataaagttttaccgctttaaaataaggagtttggttctacatgaaaacaagaagatggtttgtggattgttccgcagaattatccacaaccgatccccagattacacaagccgcggaattgctgcggcagaatgaggttgtggcttttccgacagaaaccgtttacggactgggcgctaacgctgaaaatacggaagccgtaacgaaaatatatgaggcgaaaggaaggccgagcgataacccgctgattgtgcatatatcccatatcagccagcttgatcgttttatcagccatattcctgagacggcgaaaaagcttatgaagctattctggccgggggcgctgacccttgttctgccgtgtaagcccggtgtgctgtcaccccgtgtcaccgcgggacttgagacggtagcggtcagaatgcctgatcatccggtagcattagccctcatcagctcggccggactgccgatcgccgcgccgagcgccaatttatcaggaaaaccgagcccgacgaaggccgagcatgtagctcatgatttaaacggccgcattgccggtattgtggacggcggcgccacgggaatcggagtggaatcaaccgttctgtcctgtacggggaaacagcccgtgctgcttcgtccgggcggcgtgacaaaagagcagattgaatccgccgccggttcggttcttgtggataaagggctgaccgaagaagatgaggttcctatttctcccggtatgaaatatacacattacgcgccttctgcgccgatggctattgccgacggcggcgcccggagaattcaagaactggcagacgcatataaaagccgggggaaacgaatcggcattttgacaacagaagagaacgccgatagttaccaggctgattatatcaaggtctgcggcagacgcgccgaccttgaaacagtggcgtccgccttatacgatgcgctccgcagctttgatgaagcggaagtggacatgattatttctgagtcctttccggataccggagtggggctcgccgtgatgaacaggctgatgaaagccgcaggcggcaccgttatccattaacttgttctaccccttatcggacatgcataagctaaacaagcgggcacgtccaagggggtttttatttcatgtcgaatctattcatcggggaacttgtctccttaagcatcatggcatttgctttagggacggatgccttttccgtcgggctcggaatgggaatgattcagctgaagaaaaaacaaatttttcatataggggttgtcatcgggctgtttcatgtcatgatgccgcttgcgggaatggcggccgggcatctgctgtccggttttctggggatgctcgccgtttacatcggcggatctcttcttttcattttaggggtgcagatgatcatcgccgcgtttaaacaatcagacgggccgctcatatctccggcaggctcgggactgttgctgtttgcggtcggtgtcagtctggacagcttttctgtcgggctcagtctcgggatgaacggttccaatccgtttctggccgttacgctgttcggggttttcagcaccgttttaacatgggcgggccttttggcgggaagaaaggtgcagtcgtggctcggctcgtacagcgaagcgctcggcggagccattttgatcggattcgggctgaaactgcttttaccggtataagatacgtaaaaaaagaaacgaagatgccgtttcttttttcttcatttataataggcagtaagaggtgacggacatgaaaataatctttgtatgtacaggcaatacgtgccgcagtcctatggctgaggctctttttaaatccattgcagaaacgaaagggctggacgtcagcgtaagctcggccggcgtattcgcgtctccgaacggaaaagcgtcagcccatgccgtggaagcgctgtttgaaaaacggatcgctctcaatcacagttcatctcccttatcggaagaacatatcgagacggctgatctggtgctggcgatgacggaacagcacaaacagctgattgaaggccgatatcaaaacagtcagggcaaagtctttaccattaaagaatacgtaacgggggaaaacggcgatatctctgacccgttcggcggtccgcttgatgtttataaacagacgcgggacgaactggaggagctgctgacccttttgactgatcaattgcttgacggaaaaagcaagtaatctgtcagaaaatctgcaaacaggtcatttgcaaaacgaatgtgaaagagtagaatgaaatcaacggatttcgtaataaaaaggacaagcacactgggctgtcttcgcccagccacacctaggaggtaaatgaatgaaagtagctattgcgtcagatcacggcggcatccatatccgcgaagaaataaaaagtcttttggatgaattgcagattgaatacattgatatgggctgtgaatgcggcgccggctctgtcgattattcagactacgcttttccggtagcggaaaaagtggtgaacggcgaagctgacaggggaattttaatttgcggcacaggcatcggcatgagcatctccgcaaataaggtaaagggcatacgctgtgcgcttgcccatgacaccttcagcgcaaaagcgacgcgtgaacacaatgacacgaatgttcttgcgatgggcgaacgcgtcatcggcccggggctggcgcgcgaaatcgcaaaagtctggctgacgactgaatttacgggcggccgccacgaacggcggatcggcaaaatcgcagattacgaagaaaaaaatctgtaagaggtgctggacaatggaagagatgaagcaaaaatggacggacatgctgactgagtttcaagagcaggcaggactgacggaaggcagtctgctggtgatcgggtgcagtacaagtgaagccgccggaagccggatcggcaccgccggaagcggggattgggctgaattgatatacggcggacttaaccggtttaaggaaaaaacgggtgtgcatcttgcttttcaatgctgcgagcatttaaacagggcgcttgtcattgaagcggaaacggccgagcggttcaagctccccattgtttcagccgtccccgtcccgaaagcgggcggagcgatggcctcttatgcataccggcagatgcgttctcccgtgctcgctgaatcgattcaggctgacgccgggattgacatcggtgatacgttcatcggcatgcatctgaaacccgttgccgtccctgtccggatatcaagccgtgagcttggagaagcacatgtgacgatggcccggacaaggccgaagctgataggcggaattcgcgccgtttatgaatgcgaatgatgaaaatacttttcctgtataatgttcgtgttttctaattaaattttgtgatttttttaaataagctgttacattcacctgaaaaaccatgtacaataagggtggtaaaaataaagaacaggaaacggataggagaggatctcgctgatgaaacatttacctgtacaagacaaacaagtgtttaacgccatcaaagatgagcgtaagcgtcaacagactaagatcgaattaattgcttctgaaaacttcgtgacggaagcggtaatggaagcgcaaggctctgttttaacaaacaaatatgctgaaggctaccccggcaaacgctactacggcggctgtgagcatgttgatgtcgttgaggacatcgcccgcgaccgcgcgaaagagattttcggagctgagcatgtaaacgttcagccgcactcaggcgctcaagcgaacatggctgtttacttcacgattttagagcacggcgacacggtgctcgggatgaacctctcccacggcggccacttaacacacggaagcccggttaatttcagcggcgttcaatacaactttgtagaatacggagtcgataaagacacgcaatatatagattatgaagatgtgcgtgaaaaagcgctggcgcataagccgaaactcatcgttgccggagcgagcgcgtacccccgcacgatcgactttaaaaaattccgcgaaatcgctgatgaagtcggcgcttacttcatggtagacatggcgcatatcgcgggtcttgtcgcagccggtcttcatccgaatccggttccttacgctgactttgtaacgacaacgactcacaaaacacttcgcggaccccgcggaggaatgatcctttgccgtgaagagttcggcaaaaagattgataaatccattttcccgggaatccaaggcggaccgcttatgcatgtcatcgcggccaaagccgtttctttcggagaagtgcttgaagatgatttcaaaacatatgcgcaaaacgtcatctcgaacgcgaagcgcctggctgagtctctgaacaaagagggcattcagctcgtatcaggcggaacggataaccaccttgtgcttgtcgacctccgttctctcggactgaccggaaaagtcgctgaacacgttcttgatgaaatcggcattacatctaataaaaacgcgatcccttacgatccggaaaaaccgttcgtcacaagcggaatccgtctcggtacggcagctgtgacaagccgcggctttgacggtgacgcgcttgaagaagtcggcgccatcatcggcctcgcgctgaaacatcatgaagacgaagcaaaacttgaagaagcgagacagcgcgtatctgccttgactgaaaagtttcctttatataaagaactaggctattaataaggaagaaacccgccggaaccttaatccggcgggtttttttatgattttcttgaaactgtttgtctttttctgtagaatcaatagaagtgtgaaaaagtcactcggacaacaaaaaaggagctgaacacagtatgggaaaggtttacgtatttgatcatcctttaatccagcataagctgacatatattcggaatgaaaatacaggcacaaaggatttcagagaccttgtggacgaagtcgcgtcactgatggcgtttgaaattacacgtgatcttcctcttaaagaagtggaagtgaaaacacctgttcaaacagcgacttccaaagtgatttcagggaagaaactcggtatcgtgccgatcctgagagcgggtctcggaatggttgacggcatgctgaaattaatcccggccgctaaagtgggacatgtcggattataccgtgatccggaaaccttaaaaccggtggaatactatgtcaagcttccttctgatgtagaagaacgcgaatttattgtcgtggatccgatgcttgctacgggaggttctgcggtggaagcgataaacagcctgaaaaagcgcggcgcgagaaacattcgttttatgtgtcttgtagcggctccggaaggcgtggaagagctgcagaaacatcattctgacgttgatatttacatcgcagcccttgatgaaaaactgaatgaaaaaggctatatcgttccgggcctcggtgacgcgggtgacagactgtacggaaccaaataaatcggaaaacctcattcagggggttttctttttttatccagatatttgctgaatgggcagacttcatacatttataggtgaatttgtgaacattctgtgtatgctttcggtataaaaagttttttaactttaaacagattgacacatgttaggggctattgtatgctaaacgagggtattatgagaaggttttcattcctttcatttctagtatccatcctcattttaaatcctccaaaaaacccgttatatgaggatttatctaagcgaatgaaacagcatcccgtggcatcaggaggatgagtggttttttcgaacaggccgttttgcggacaaaaaaggccttctgcaagggttaaccgcatgttttgccgtatccaggaattatattacattttcatcaggagacagatagttgatggacgatcccaatcttacattcagcagacaacggagatatgtatttgtaatcttagcaatctatttgctgggatatggtcttacggcgtataaaactgtttttttaggcctctttttgggaactgttttcagtttgtttaatttgtggctcttgaccagaagaatgaatgcttttgacaaggccgtggcgaaaggaaagtccatacgatcactcgggagcgcagcgcgttggtgcaatgcgatacttgcgatggctgtcgcctttaaatatcccgataaagtcagtgtggcaagtgtgattattggattaatgacaatttatcccgtcattatgatagattccattattcagctcaaacgttcatcaatggaagagaggtgaaaacccattgaatcacgattacagaactattgatttgtttggtcttacttttaatctgacaaacattctgatgattactgtggcaagtgtgattgtgctgctgattgcgattctcactacgagaacgctgtccatccgtccgggaaaagcccagaacttcatggaatggattgttgattttgtccgcaatattataggcagtacaatggatttaaaaacaggggctaacttcttggcgcttggtgtaaccttgctgatgtacatatttgtatcaaatatgctagggctgccgttttctgtaacggtcggacacgagctttggtggaaatcaccgacggccgatccggctattactctgactctagccgttatggttgtgtcgttaacgcactattacggcgtgaagatgaaaggtttgaaggaatattctaaggattacctcagaccggttccgcttatgttcccgatgaagatcattgaggagtttgcgaatacgctgacactcggacttcgtctttacggtaacattttcgccggggaaattcttcttggcctgcttgcgaatctggcgacgaatttctactcaaacagtttctttctcggtttggtcggcacagtcggagccattattccgatgcttgcatggcaggcattcagcttgttcatcggtaccatccaggcatttatctttacgatgctgacgatggtgtacatgtcacacaaaatcagtcatgatcattaaaatcatatatccattcggataacattttaaaggaggaactttttcatgaatttaatagcagctgcaattgcaatcggtttaggtgcacttggtgcaggtattggtaacggtctgatcgtttcacgtacggtagagggaatcgcccgtcagccggaagcaggaaaagaacttagaactcttatgttcatgggtatcgcattggttgaggcccttccgattatcgctgtcgttatcgcgttcttagcgttctttggctaagcaaaaaagccttatatgaactaaaaatggcgaagatcactctaagagaaccttcgccattgctttatgtctgataagcaggccgtcccaaaacggctttttatcagcagagaaaacctgcagaagggagttgccgtagtagatgtctcaattacctcttgaattaggactgtcgtttaacggcggagatatcctattccaattgttagctatgctagttttattagcgcttctcaagaaattcgctcttggaccgctattaaatataatgaaacagcgtgaagatcatatcgccggcgaaattacgtccgctgaagaaagaaataaagaagcgcagaagctgattgaagagcagcgcgttcttttaaaagaagcgaaacaggaatcacaatcactcattgaaaatgcgaaaaaactgggtgaaaagcagaaggaagacattatccaggctgcacgcgccgagtctgaaagattgaaagaagcggcgagaaccgaaattgtcaaagaaaaagaacaagcggtttccgcacttcgcgagcaagtcgcatcactttctgtcttaatcgcatcgaaagtgattgaaaaagagcttgatgaacaagcccaggaacaactgattcaggactatcttaaagaggtaggagaaagccgatgagtggatctgctgtctctaaacgatacgcgtcagcgcttttcgacattgccgttgagacttctcaaatcaatgaaatcgaagaagagcttaccgtactaaaagaagtgttccggaacgaagccggattacaggaagtgttaagccatccgaaggtatcggccgctaagaaaaaagagctgattcagcaatcgttcggcgcactgtctgagtctgtgctgcatacgatttttcttctgattgaccgccgccggtcttcgattgtgcctgatctcacagacgagtttatcaaacttgccaatcaggcccgtcagacagaggacgcggttgtttattcagtaaaaccgctgtcagaagcggaaatgttatcattgtctcaagtgtttgcaaaaaaagccggaatcgcttcgctcagaatcagaaatgaagtgcagacggatttaataggcggcattaaagtccgcattggaaaccggatttatgacggaagcgtaagcggaaagcttgagcgcatggaacgtcaacttgccggaggaaatcgatagaaggggtgaaacctaagtgagcatcaaagctgaagagattagcacgctgataaagcagcaaattcaaaattaccaatctgaaattgaagttcatgacgtaggtacagtcatccaagtcggagacggtattgcgcgtgtgcacggccttgacaattgtatggccggtgaacttgttgagttttcaaacggcgttttgggtatggctcaaaaccttgaagaatccaacgtaggtatcgttatcttaggaccttacagagatatccgtgaaggtgatgaggtcaaaagaacgggccgcatcatggaagttcctgtaggtgaagaattaatcggacgtatcgtcaacccgctcggacagccggtagacggactgggtccgattctgacaagcaaaacacgtccgatcgaaagccaggctccaggcgtaatggaccgtaaatcggtacatgagccgctgcaaacgggtatcaaagcgatcgacgcgttaattccgatcggccgcggacagcgtgagctgattatcggtgaccgtcagacaggtaaaacatctgttgcgattgatacaatcttaaaccaaaaagatcaagacatgatctgtgtgtacgtagcgatcggtcaaaaagaatctacagtgcgcggcgtggtggaaacacttcgtaagcatggcgcgcttgattacacgattgtcgtgacagcgtccgcttcacagccggctccgcttctgtaccttgcaccgtatgcaggggtgacaatgggtgaagaattcatgtacaacggcaagcacgttctcgtcgtatatgatgatttatccaaacaagcggccgcttaccgtgagctgtcattgcttcttcgccgtccgccgggccgtgaagcattccccggggatgtattctatcttcactcccgtctgcttgagcgcgcagccaagctgagtgacgcaaaaggcgcaggatcaattacggcgctgccgttcgtcgaaacacaagcaggagatatctccgcttatatcccgacaaacgtcatttccattactgacggacagattttccttcaatccgacctattcttctcaggcgtgcgtcctgcgatcaatgccggattatccgtatcccgtgtcggcggatcagcccaaatcaaagcgatgaaaaaggtagcgggaacattgcgtcttgacctggcttcataccgtgaacttgaagcgttcgcccaattcggatctgatcttgaccaggcgactcaggcgaaactgaaccgcggtgcgcgtacagttgaagtgctgaagcaagacttgaataaaccgcttccggttgaaaaacaggtagccattctttatgcgctgacaaaaggatatcttgatgatattccggttgcggatatcagacgttttgaagaagagtactacatgtaccttgatcaaaaccataaagatctgcttgacggcattgcgaaaacaggaaaccttcctgctgatgaagacttcaaagctgcaatcgaaggtttcaaacgcacatttgcaccaagcaactaacccttagaagatgagagaaaaaggttctctttttctctctttttacgcaaatgaagaataaaggtggtgaaatctttggcctcattacgcgatattaagtcaaggatcacgtcaacgaaaaaaacaagccagattacaaaagccatgcagatggtatccgctgcgaagctgaaccgtgcggaaaccaacgcgaagtcatttgctccgtatatggataagatccaggaggttgtgtttaacgtcggaaaaggcgcgaaaaacgcgaaacacccgatgcttgtctcaagagaagtgaaaaagacggcgtatctcgtcattacgtctgaccgcgggcttgcgggtgcgtttaacagttcggttttgcgaaacgcttaccgcaccattcaagaacgccatcagtctaaagatgaatacacggtgattgcaatcggcagagtcggccgcgatttcttcaaaaaacgggaaatgccgattttgtctgagttagtggggcttggcgacgaggtcacttttgctcagattaaagatttgacccgtcagacggtacaaatgtttatcgacggcgcttttgatgaactgcatttggtgtataaccatttcgtcagtgcgatttcacaggaagtgacggagaaaaaagtgctgcctttaacggatttcggaacgagcggcgggaagcgcacggcttcatacgagttcgaaccggatgaagaagaggtgctcgaagtgctgcttcctcaatatgcggaaagcttaatttacggcgcgcttcttgacagtaaagcaagtgaacacgctgcgagaatgacagcaatgaaaaatgcgactgataatgcgaaagaactcattgattcactttcgctttcatataaccgcgcgcgtcaagcggcgattacacaagaaattaccgaaattgtcggcggtgcagccgctttagaatagaaagattttgtcaggagggatagcgatgaagaaaggacgcgtaagtcaggtgcttggaccggttgtcgacgtacgtttcgaggacggccacttgcctgcgatttataatgcgattaaagtttcacagccagctacaggcgaaaatgaagtaggcatcgacctaacgctagaggttgctcttcatttaggcgatgatacagtccgtacaattgccatggcatctacggacggaattcagcgcggaatggaagctgttgatacaggtgcgccaatttccgttcctgtcggtgatgtgactctcggacgcgtatttaacgtactgggagataaaattgatttaaatgaaccgctgcctgcggatgctcaaaaggacccgatccacagatcagctccttcattcgatgagctttcaactgaggttgaaattcttgaaacgggaattaaggttgttgacctgctcgctccttacatcaagggcggtaaaatcggattgttcggcggcgccggcgtaggtaaaaccgtattaatccaggaattaatcaacaacatcgcgcaagagcacggcggtatttccgtattcgccggtgtaggagagcgtactcgtgaagggaacgaccttttctacgaaatgagcgattcaggcgttatcaagaaaacagccatggttttcggacaaatgaacgagccgccgggcgcacgtatgcgtgtagcattgacgggtcttacaatggctgagcatttccgtgataaacaaggacaggacgtactgttctttatcgataacattttccgtttcacacaagcgggttcagaggtttccgcgcttctcggccgtatgccttctgcggttggttatcagccgacgcttgcgacagaaatgggtcagcttcaagagcgtattacgtctacaaacgttggttcagttacatctatccaggcgatctacgtgcctgccgatgactatactgacccggctccggcgacaacgttcgctcacttggatgcgacgactaaccttgagcgtaaattaactgaaatgggtatctaccctgcggttgatccgctggcttccacttcccgcgcgcttgctccggaaattgtcggagaagagcattatgcggtggcgcgtgaagtccagtcaacgcttcagcgttacaaagaacttcaggatattatcgcgattctcggtatggacgaattaggtgaagaagacaagcttgtcgttcaccgcgcacgccgtatccagttcttcctttctcaaaacttccacgtagctgagcagtttacgggacaaaagggttcttacgtgcctgttaaagaaacggtacgaggctttaaagaaatcctttccggtaaatatgaccatcttccggaagatgcattccgtcttgtgggacgcattgaagaagtcattgagaatgcaaaagagatgggtgtagaagtttaatctggtcctaggagggtaaaagcatgaagaccgttaaagtcaatatcgttactcccgacggcccagtatatgatgctgatattgaaatggtaagtgtaagagccgagagcggtgatctcggtatcttgcctggccatattccgaccgtggctccgcttaaaatcggcgctgtccgccttaaaaaagacggacagaccgaattggcggctgtcagcggcggatttttagaagtccgtcctgatcaggtcactatccttgcacaagccgctgaaacagcggaaagcattgataaagagcgcgcccttgctgcgaaaaagcgggcggaagaccgtttgaacaaacgatcagatgatactgacattcgtcgggctgagcttgcgctacagcgggctgtaaacagattggatgttgcaggaaactaaaaaagaatccttctcggctgtctgagaaggattctttttctatattaacgcataagagattcatagacgccgataagcggatgatcctcttctttttgcagatataaatgttcgcagcagttgtcggtgtgccacgttttgtttcctctccgcacacccgtcgtataagcgccgtccgtatacggataaggtttgacgacccattcggcatcgtcatggtgtctgatggcgcaatcgatgacatacacactgagcattttctcaaattcgtcaatcggcaggttccaatccgccaaaagcagctcttgtatgctgcggaagtaaagagcttccacttccagcaggctgccgcgtgaataatcaagagaaatgttgaaaaactgacataattctttcagttcctctgtttgagactgtctataatcatagtagaatgctatcgcttcccactcgtggtcaaatacgggaagagtttctccatactgcttttccggatgaaaaaaggaatgattcatattcccatctcctttccaaaaaagtatatcatgccggagaacggacatttaagcggggattgcccctaattttggataaaaattctgatgtaaaaatgatcatctttctctcttcttcttatataataagagaggatatgaggggcggaaaaaatgaaaggagatggaatttgtgaatgtattggggcagcaggccgcaatcagcatcctggttcacctggtatgcattgcggtgacatggtgggcgcttcaggccgtcaactttgatccgctgatccgaaaaggaaaaatagtgcaggcgaggctgctgatcattcttcttaccattgcgatcggtacggcagtcgctgacttctttttagattatcttacctattcgaaacagcttccatacttattttaagatgtttcgtctgttgaaatgaagggaatcgctgggtgagaaaccaatttttcttcacccgcttggcgagttttgacgaagttttccatgtattgctttccccggctccggcaaaaatgggagtaagggggagagatcgatatgaagaaaaaaagagcaggccgcatcatcttattttttgtttttttaagcgccttaatagcggtatttcattccattcatgcaagtgagctgtctccgcttgcccagattgccgaaggaatggagcggcagcaggtcactgtagatgaatggacgcttcatgcgaaaaaaaatctgaacctgtcactgagtgaatttgatgacaaggtaaaagaactgaagacgcagtatccgcaatatcattgggaatccgcgcgggaagataaaatcgtaaaggccgtcggcacgtattctgacaaaaaaaatcacacaacttttaaactgcagctcgtcactaccctcaaaaaccagaacccaacttcgtatttattatatgagcaaatgagcccggagcaaccggaaaactggaatgatacatatgaacagtttgaacggcaggcacatgacatatttcaaaataaagtatttatttttacttgtcttaagggtcatttaaatgataatatgagtattgttttgcaaaaaaaagcagaacagctcatgaaagaatttgaagcaagtccagttgaacatgtagttgagcctcatttcgtttctgtttctgcatttacatataagtggacagattacatcatgacatcgaaacataagatgaatgtgcaagttgcgcttagaagtgcgggaatgggcgaaaaacataccgttacggttggcacaccaatcgtgacgactgaatattaatatagagaatatagggacgcggaggggaataccttggaaaaaatcatcgtccgcggcggtcagaagttaaacggcacagtgaaagttgaaggagcaaaaaatgccgttttaccagttatcgctgcatctttattagcaagtgaagaaaaaagcgtaatatgtgatgtacctacgctctccgatgtatatacaattaatgaagtgttgcgtcatttaggagcagatgtgcattttgagaataatgaagttaccgtaaacgcttcttacgctttagaaacagaagcaccttttgaatatgtgcgcaaaatgcgcgcgtcagtgcttgttatgggccctctgttagcccgtacgggtcattcaagagtagcgcttccgggcggctgcgcaatcggctcaagaccgattgatcagcatttaaaaggctttgaagcaatgggtgcaaaaatcaaagtaggcaacggctttattgaagcagaagtagaaggccgtctgcagggcgcaaaaatctatttagatttcccaagtgtgggtgcgacagaaaacttgattatggcagctgctttagctgaaggaacaacaacgcttgaaaacgtggcaaaagagcctgaaatcgttgacttagcgaactatatcaatgcgatgggcggaaaaatccgcggagccggcacaggcaccattaaaattgaaggtgtcgagaagcttcacggcgtaagacacaacatcattcctgaccgtattgaagcgggtactttcatggtggctgcggctatcacggaaggaaatgtattagtcaaaggtgcggtgcctgagcatcttacgtctttaattgcgaagatggaagaaatgggagtcaaaattacggatgaaggagaaggccttcgtgtcatcggtcctgcccagctgaagccgatcgacattaaaacgatgcctcacccaggattcccgactgatatgcagtcgcaaatgatggcgctgcttctccgtgcgagcggaacaagcatgattactgaaactgtgtttgaaaaccgttttatgcatgctgaagaattccgccggatgaatggcgacattaaaattgaaggacgttctgtgatcattaacggtcctgtacagctgcaaggcgcagaagttgccgctacggacctgcgtgcgggcgcggcgctgattcttgcgggattagtggctgaaggtcatacacgcgtcacggaactgaagcacttggatcgcggttatgtgaatttccataaaaaacttgcggctctcggcgctgacatcgagcgtgtcgttgatgaaacggccgctgaacaagaaagcaaagaagtcgtaactgacctaaacgcataatggctgtaaaaacagtatgtcaatctggcatactgtttttttatggtttatcatcattattatgctctgatttccaaaaaagaatacgtttttcgcgtgaaaaatggaataaagattctgtccaaaaggaagtcatattagcttgtccctgcccataagatgaagtagagtcgaatcccaagcaggaggcagctgatatatgaaaccgattgtatttctactatccgggctgtgtatacttattcttctagtccccaccattctcgtccttccgtttcaggcagaaaaaggagcagccgtaaacagagagcccggacacaaaacagcacacaccacacgagaaacaaaaggagcagaaacattgaaagaatcacctgtatccattccggtttatcggacatccaatcattctgtagaaaacattccgcttgaagagtacgtgatcggtgtcgtggcttccgaaatgcccgcagattttaaaccggaggccttaaaagcccaggcgctcgccgcccggacattcatcgtcagactgatggtcgctgactcagccgtccaggcgccgaaaggatcactggtggatgatacgcaaatgttccaagtctatcaaagcaaaagccagctgaaaaaagaatggggttctaagtacgcacacaacctcaagaaaatcacaaacgcggtggccggcacgcaaggaaagattttaacgtacgataacaagccgattgaggcatctttcttctctacgagtaacgggtatacggaaaatgcggaagcctattggacaagcgccattccttatttaaaaagcgtgaaaagtccgtgggataagcaatcgccgaaatatcttgccacccagaccttcagtgtgccggagtttcagcaaaagctcggcgtacagctctcaggacaaaacacggtgggacagattacagccagaacgccgggccatcaagtggcaacggccgtcatcaacggcaaaaagctgaagggaagagacatccgggaaaaactcggactccgttctgccgactttgaatggaaacgaaacggcagcagcatcaccattacgacaaaaggattcggccacggcgtcggcatgagccagtacggggccaattacatggcggagcagggaaaatcagtggcggacatcgtcaagcattattatcagggagtggacatttccgaagcagattcatttttaaacaaatatatggcgaaaaaatagacgctttcatgagcgtctgtttttttgaaaactattccataaacggtaaagcaaccaacagactcatataacgaaagcctaaaggctgacaaatgtcgattgaaggctgagcgccgggtgtaaatcactgataaaaatgccgcttctatgtgaatatacgcaaaaataatgaggaacgccgtcctatttatttcccttttcatctcatttacgataaatattgttcggcgttgaacgtaaatctattgaaaaggggaaaaagcaatgaaaaaaacattttcactcatactcatgctcggattgatgctgactgctgcatctcctgcttttgctgtcgagaatgcaaacgagaagactctttcatttaaaaacaataccgccattttacttgatgcgagcggcagtatggcaaaacggattgacggtgtttctaaatacaacatggcaaaagaagaaattgtccgttttgcggatcaaattaaatctaaatcacaggtcagaatgacggttttcggttcggaaggcaataataaaaactccggaaaggttcaatcttgtgaatccattcgcggtgtgtacggattccaaaggtttgacagacagagcttccttaactctcttaacggaatcgggcctacgggctggacaccgattgcaaaagcattagaggatgcgaaggcttcctttaccggtttgcacaaacttggcagtaaatccgttttcctgttgacggacggcgaggagacatgcggaggagatcctgttaagacagcgaaagaacttcgcaaacagcatattaaagtcaacgtgatcggctttgactttaaggaaggcttcaacggccagcttcacgagattgccaaagcgggcggaggaaaatattacgaagctcacagccaaaaggatatgaaccgcatctttacaatggcagcgagttcattagcggaataagaaaaggtgccgtttatcggcccttttttttatttttatttaacaaaaatttcaagaaaagatgaagagaaaactgtaaaaagaatcagattccggacttatattacaaaaagggcgaaaaaggcattaaatctgtcatcatttatccaatctttttaggatgatgcgcataattctgttcatttttaacggcgtacagccgcttatacaaaaggaatcccgccctatatctttttgcatacacgtcatctagcatagagaagagccgggggcccatcggccaaaaacaaacggagaggaatgaaggaaatgaaaaaaatgttcactgcggggattgtcggacttttgacgctttcactcggatcacctgtttttgcagctgagaaaaagcacgaagaaacaaacgttgctgtgctgtttgatgcaagcggaagcatgatacaaaaaacagggggagagcgtaaaatagatgttgcgaaagagtctgtcacttcttttgcggaagttcttcctgaagacacgaatctgatgcttcgggtattcgggcataagggcaataataaaaactcaggcaaagccgtatcatgtaatgcgacagaaacgttatacggccttcagccgtacgccgtgactccatttgagcaatcactcagcaagattaaaccgaccggctggacaccgatagcgaaagcgctttctgatacgcgtgaagaatttgagcgggccggcgccacagggaaaaacgtcgtatatctgatcacagacggtgaagaaacatgcggcggtaatcctcaggccgaaattcaaaagctccgtaaagcgaacgtcaacacgatcgtcaatatcatcggcttcaacttcggcatgaaaggaagcgaaagccttgaaaaagcggcggaagcgggaggcggcacatatgtctcagctgacagcgcggacgagttcaaacaggcttgggaagacgctgcaaaggatttagcaaaagaataggttaaaaaaggacgcccgcgcggcgtcttttttgtttagaaaacggaaccgcgggaatgatacggataaaaggagatgaacgctgttgttaaaaggagcaggcattatattagtgctggcggcagtcgtttttgttctgatgggaatttttctgaagcttgccgccttcatattcgtcagtatattggccattatcgccgcagttattttattcaccattctgagcagacatcatcgcaatgaaacatagagtcctaagagggctctttttttaaaccgcaaattcgacaaaatacagggattgtggaagaataaaagagaaggatactgcggaggggaaaacagtggatgaaaaaacaacagcggttagagacatataccgctatgaaaaaggggtattaacaaagacggcagatcggatggtttcagagtatccgctgaccgtcatggtgaacggacaggaatttgttacgctcgtctgcacgcctgaccatttagaggaactcgtcatcggatttctcgcatcagaaggcgtcattcgttttgaaaaagaaatcaaaagctttactatagatgaaagtctcgggtttgcatatgttgaactgacgaatcccggagtgcttgagcaaaaagactatacgaagagggtcatcggttcatgctgcgggaaaggccgccatttttactttcagcaggatgtgaaaacggccaaaaccgccgtcagccgtatcactataactcctgagacgtgccttcgcctgatgaaggagatgcaaagaggaagcggcaccttccaggaaacgggcggcgtccataatgcggcgctgtgcgatacggaaaagctgctcttcatgaggacggacatcgggcgccacaacgcgctggataagctgtacggctgctgtttgaaaaacggaatgccggtccgtgacaagctgatcgtcttcagcggccggatttcctcagaggttttattaaaagccgcaaaaatcggcgtgtcgattgtcatttcaaaatcggcgccgacggagctcgcgctgcaaatggcggaagagctgaacataaccgcgataggttttgtcagaaacggatcatttaacgtatacacacatcctgaacgggttgaacaatagaaaggggtcttgggcttatgaatacagaaacgcgccgggtgacagacaaaagggaaaggccgctcagggatcttcgtatctctgtaaccgaccgctgcaacttcagatgcacgtactgtatgccagccgaattattcggaccggattatccatttttacaaaagacggaattgctctccttcgaggagcttgagcggcttgcgaagctgtttgtcggccgcttcggcgttgaaaaaatcaggctgacgggcggagagccgctcatgagaaaagatatgcctgaattgatcaaaaaacttgcgcgcatccccggacttaaagatatcgcgatgacgacaaacggctctctgcttcccgtgtatgcggaaaaactgaagcaggcggggctgcatcgcgtgacagtcagcctcgattctttagaggatgagcggtttaaggccattaacggccgcggggtttcggtgaacaaggtgcttgagggcattgaggcggcaaaagcggccggactcggtgtgaaaatcaatatggttgttcaaaagggcgtcaatgaaaaagatatcctgccgatggcccgctattttaaagaaaagggtcatattctccggtttattgaatttatggatgtaggcaatacgaatcaatggaataaaaaagacgtgatcacgaaggcagagattattgatctgatcaaccagcacatgccgacggagccgatagaagcgaattataaaggagaggtcgcttccaggttccgctatcttgacggttccggcgaaatcggcgtgatttcctccgtctcggatgcattctgcgcctcctgcaacagagcgcgcctgtcggcgagaggcgagctgtttacgtgcctgtttgcgtcaagcggctatgatgttcggaaactcgtgcgcggcggtctgaccgatgatgaattgacggaatccatcgcttctgtctggagaaatcgcacggatcagtattcaattgaccgcgcgctttctaaaacggatgggaaaaagaaagtggaaatgtcttatataggcggatgaagaaaagcctgcccggacaagggcaggcttttttattcacaatatgagagcggtctgttcaaaaaataccgatgacagccgaaatatatgataggaattttgatgcaggacaatcaagttatgcaattccaaagccatacaatatgttaaaatataaccaatagaaattagaaaaggttgtgaaaggggcatgaccgcatacgagattccgtcatctcaagttggagtcaagatcaacaaatggtacaagcacattttagcgtttcaagcggctgatgccataaagctgaaagaggaaattgatgaggatatacaacgtatggaggaagaccagctgctgctgttatattatcagctgatcagctaccgccatcatattatgcttgattacgtcaagccggaatgcaccgaacaatcacagattcagtacagcgagctgcaaaagacgatcgaaagcacggacagcatatcgggactgtctgagtattatttccatttgttcagagggatgtatgaattcgatcacaataactatgttgcggctatttctttttaccggaaagcggaaaaactcctttcatttgtcgaggatgatatagagagggcggaattccatttcaagatgtctgaagtgttttatgtcatgaagcagactcatttttccatgaatcacgggattcaggcgctggatacgtatatgaaacacgatttctacagagtgcggagaattcaatgccatttcgtcatctcaggaaactacatcgactgcaaaaactacgacaaagcgcttgagcatttagacgaagccctccgcctttctttgcttgaaggacagccccgcctgatcgggtcttcgctttacaatctggggaattgttattctgaaaagcgagatctgaatgaagcggcccggtactttagaaaagcggttcccgtttttgaagagcatcagcttgaacagcttccgaaggcgctgttcagcttaacgcacacccttttcaggctgcatgatgaccaagcggcccttacctattatgaaagaggggtcatgattgcgaaagaacggggcgatcgattcagtttagagaagtataagtttttacaagcgctttatttggagtcactcaatatggatttaatccatgaagtgtttgactatatgaatgaaaaatcgctgtatgtgtatattgaagatttcgccttggaggccgccgtttacacaagcgcacatgagcaatataaagaagcggcgtatttttatgaaaaagcgattcgcatgagagaaaacattcaaaaagaacaatgtttatacgatatataattttcttaaccatctgatcagcagatggttattttttttatgcacattataacgtttgaccatagaaaaaaacggaaaaatcgcaaaagagagaaaaaagtatgatgggaaggagggatttgttgttcggattcaatgatatgataaagtttttcgtatcatttctcatcattctgccgatggtgtctgtcatccatgtgtcgggacacagctttatggccatgctgttcggaggcaaggcatcattggatatcggaatggggaaacgtcttttaaaagtagggccgattcaggttcggcgtatctacttcatagattctttctgcaagttcggcgaattgcggatagataaccgtctgacgagcgcgctcgtctattccggaggctgtctgtttaatctcgcttctatctttttaataaatctgctgatcataaaagatgtcctcgagccaaacttatttttttaccaatttgtctatttttcaacttattatgttttctttgcgcttctgccggtgcaatacggggataataagctgtcagacggattggctgtttacaaagtgctccgctacggggaacgctgtgaaatcaataattgagagtttacatgtttgctatcaggctgaaagggaagaaaacaagtacacagaacaaaaaaggagctgaagagatcatgagtcaagataacggtttaaaagacaaagtaaaaggcggcatgaacaaaatgaaaggggaagcaaaggacaaagcaggcgacatggcaaacaagtccgacttaaaagcggaaggtaaaaaagacaaagcgaaaggcagcctgcaaaagggtgtcggcaaaacgaaagataaactcagtgatgattaatttgatagtgaaacacagcaaaagcccaaaatattttgggctttttgttatgagaaatgacaaaaattccagttcatttggttaatattcactaaatttttaaatattctataaattccccggcgatttctttataatattcacatagaatgtaacctttcttcacatttgattaaacgtttgttgaagaaaaaaatgagaaatcggtaatttctgcaaaaggaatcgggccgttcaccgtcgaataacttttatcacttaacatttcatgaggtgaagggggtgacggccgcctgcatcgtttcggtatgaccatgcggattgtgtttgactatcactaagggggaatacagatgaaactgacaccggttgaacaagaaaaattgcttatttttacggcgggagagctcgctaagcagcggaaggcgcgcggcgttctgctgaattatcccgaagccgccgcatatttgacctgttatctgatggaaggcgcgagagacggaaaaagcgttgctgagctgatggaatccggccgcaatgtattgacggaaaaagacgttatggaaggcgttccggaaatgctggacagcattcaggtggaagcgacgttcccggacggggttaagcttgtcaccgttcatcagccgatcaaagcggaggtgaagtcatgaagccgggagcgattcaagtcgcaaaggggatcatcaccattaacgaaggccggaagacgctggaggtgtcagtcaccaataacggaacacggtcagtgcaggtaggatcgcattttcattttgccgaagccaacggcgccctttccttcaatcgggacaaagcaatcggcatgcgccttgatatcccgtcaggcacatctgtccgttttgaaccgggagaagagaaaaccgttacgctcgtggaaatcggagggcgaaaaacggtcagaggtctgaacggcatggccgatacgtatatggatgagcggggaaaagagaagactctgtcaaatcttaaaaaagccggatggatggaggaggcgatccgatgaaaatgtcacgtgagcaatacgcagaactgttcggaccgacaacgggagacaaagtcagactcggagatacggatttatggattgaagtcgaaaaagatttcacgaattacggtgaagaaatgattttcggcggagggaaaacaatccgggacggcatggggcagaacgggcgtatcaccgggaaagacggagcgcttgatctggtcattacaaacgcggttatcctggattataccggaatcgtcaaggcggatatcggggtgaaggacggccggattgtcggcgtcggaaaaagcggcaaccctgatattatggatggggtggacccgcacatgattatcggtgccggaacagaagttatttccggcgaagggaaaatcgtaacggccggcggggtggatacgcatatccactttatctgcccgcagcagatggaagtcgcgctttcttcaggcgtgaccacgcttctcggcggcggaacgggtcctgcgacgggaagtaaagcgacgacttgtacatccggtgcatggtacatgtcgagaatgctggaagcggccgaggagtttccgatcaacgtcggtttcttaggaaaagggaatgcatccgataaagcgccgctgatcgagcaggtggaagcaggcgcgatcggcctgaagctgcatgaagattggggatcaacgccaagcgccattaaagcttgcatggaagcggcggatgaggcggacattcaggtggcaatccatacagacacgataaatgaagcgggctttttagaaaatacgcttgatgcgatcggcgaccgggttatccatacatatcacatagagggagccggcggaggccacgcaccggatattatgaaactcgcatcttacgccaatatcctgccgtcctctacgacgccgacgatcccgtataccgtcaacacgatggacgagcatcttgatatgatgatggtctgccatcatttagattcaaaagtgcctgaagacgtggcgttcagtcattcacgcatcagagcggccaccattgcggcggaggatattctgcacgatatcggcgcgatcagcatgacgtcatctgactcgcaggcgatgggcagggtgggagaagtgattatccggacatggcaggtggccgataaaatgaaaaaacagcgcggcgctctatcaggagaaaacggcaatgacaatgtgcgcgccaaacgctatatcgccaaatacacgatcaacccggccgtcactcacggcctgagccatgaagtcggttccgttgaaaaaggaaagctcgccgaccttgtactatgggacccggttttcttcggcgtcaaacctgaacttgtgctcaaaggcggcatgatcgcccgcgcccagatgggagatccgaatgcttccattccgacgcctgagcccgtgtttatgcggcagatgtacgcatcatacggtaaagcaaaccgaaatacctctattacatttatgtcccaggccggtatcgcaaacggtgtgccggaaaagctcggccttgaaaaaatgatttctcccgtacggaatatccgtaagctgagtaagctcgacatgaagctgaatgacgcgatgccgaatatacaagtcgatccgaaaacctatcaggtgttcgccgacggagaagagctggcatgccagcccgtcagctatgttccgctcggacagcgttatttcttattttaatccctcttcggccggtttcccgccggcctgtttacacctctattgccaacttgatttcatcctgccgcccgttttagtgtatattagtagttgacaaacaaatgaaatgtaactattgcggttacaacggtggtgaaaaacatgattaacagccgtcttgctgtggccattcacattctatcgctgatctcaacggatgaacgggcgtcatcggatatgattgcgggcagcgtaaacactaatcccgtcgtcgtgcggagaacgatcagccagctgaaaaaagcgggtattctgacatcccgagcgggtgttccgggagccagcctgaaaaaagatccgtcggagatcaccctcttagaggtttacagggcggtgcagaataaggaagagctttttgcggttcacgacaatccgaaccccgactgtccggtcggcaaaaatattcagcgcgcgctcgatgagacgttcggaagcgtacagcgggcaatggagaatgaacttgcgagcaagtccctttatgatgtaatgaatcatctcttttgttaaaaagagatgggttcatgccgctataggtgtaacaaaaatggttacaagttataatgaggaaatcacggttttggctccatattcagacaagcctggatgcggattgcgatctgtttaatgaagaaatccttcgaaactaaaggaggtggttaccgggatatttatattttgcttaagacttatgtgaaggtgtcagctgtgagctagttaaacaaaaaatgataccctgcctccagcaatgccaaaaccgttcgcctcttaacaatcattgtaaaatttctctaggaacgatcagcagcccgttagctgcccctaattaaagatgagctgttaccacactgttacattagaacttccgctgcttttatatccttctgtcgctaagacttgataagcccaattactgcccagattcattccatggctcttccatgcgttaacatgattgctgaaagtgattgcagcgttgcttccggtcggtctcttcgactggcgaacactccagtactgcgtaaaagtagtgttatcgccatcaatggaaggtgcattataacgtgtcgttgtatatatgtcatatgtacctccatcactgtttacagtccctttatacgttccggtaggtctgtaagtaccccatgaatccactacataatattcgatgagaggtgctctcgtccagccatataaagtcaaatatccattgccattcggcgcccagactccggcattatagtttattgttctaaatggcgagcctgtagtccagcctttaccaacaacgaaatttccggtattagaccaattaacactgtaattcccgccagatccattgactgcgtttactgttccgcccccatcagtccaattttgccagtaatctgtaccagctgcagaggcggttgccgaaaacatgctgatactcatgaaagctgccgttaatccaactaagaatttctttttaaacttaaacatatgttacctcctatactattttttctgactttgacatgaggcagcactcgtaaatatttaacgaacgccaacgcttttgatcgttcctttcaatataatagcatgaatacatgagtgaatattaagaacaattgtaatttaattacaaagacccaaaaaactgtatgataagtggtcttgttccatcagggcttttatccttattttgcagaatcacaattcttgcttctaaacctgatcaggaacagtcgaacaattgagtgatttcagttgaaactctgaggaaaagctttatttgaataaacttttttgagctgaagccggaatgtctgaaagaatatttgcagacagctgcatcagctgcgccattatgccatcgccgtattggcaaatccgaagcacaaaaacgaacgctttaccgttattgaagaagcggaataagaaaaaatcccgggcggatgcgccgggattttcctttttaatatgtattggcatcaatattattaaacacgccgtccacgatgccgagcgtcatgaggacaatgaagagaacgataccgagaacggacaagccgaccgtcacaatcaggtagatcccctgcattttcacgaactttgcataattctccagcatatgttcctctgtcagttcattgaactgctccgccatctgtcccgcttcatttgccgagcgcatcagaaaaatgccggcaatgatctgcagaacgccgggaatggctccgattaaaaagaaaaacgcgcccgacagcgccgcaaacgcacccacgataataaataaaatacctgtcgcttttccccatttcgaaatagaaataagcgaacgattcactgattcaggtttcaaactatggcactcctttacaaaaaaatactcacttttcatttatacactattcggtcattcttttgaatataaaatgtgttttttcatgccgtgtccgtttttatatcagaaaattcccgagaaaacaccccgggaattacaaaatcggcgaaagaagtcttgaaatcgattctttaatgcggatccgcagcgaacgctcctgatattcttcatacgtatattttctggagacgagcagatcttctttaaatgaggaaatgagttttttcgcaatggtgacgtcataaataaaggcgttgacttcaaaattaagtctgaagcttctgacgtcgatattcgccgtaccgactgaagccgtctcatcatcgacgacaatcgtttttgcatgaataaagccgttatcgtaaatgtagactgaggctccggctttcaaaagatcgccgatgtaagataaagtcgcccagtaaacgaaagcgtgatccggcttgttcggaatcatgattttgacgtcgatgcctgacagacaggcgatcctgagggcatctaaaagacttgagtcaggaataaagtaaggcgtctgaatcaggattgaccgtttggccgttgagatcatcttgatatagccgtttttaatttgttcccattctgagtccggtccgctcgtgacaatctgcatcccgacgttgcccttcggctcgcattccggaaaatgattcggaacgtatgtgagcgtatgatgatgggaggcttggttccaatcgaggataaaccgtgtctgaatggcgtgtaccgccgtgccttgaagcctgaggtgcgtatcgcgccagtagccgaatttcggattcaggccgagatattcatctccgacgttaaagccgccgacatagccggtttcgccgtcaatgatgacaagcttgcggtgattccgataattgagccgcaaattaatcggacgaagcctggaaggaaaaaagacttccacatggccgccggcgtcccgcagcggtttgaagaatttttttctgagtgatcttgaaccgagttcatcatataacactctgacttttacgccttcacgtgcttttttcactaaggcatcgcgcaatttttttcccagttcatcacctttataaatatagtattgaaggtgaatgtgatcttttgcgttggaaatgtccttcattaagcgtttgaacttatcgcgcccgtccgtcaaaatctccaccgaattatcctctgtaaagaccgcgtggttgttcatgacaagcatatagatgaggtctttattatccacagtcgccctgttgttaaattggaattgcctcgacttcagatctttcagctgaaacttcagcagcttttctatcccgatttttttacggtcttcccactgaaacagatgcttgcgtctcaggttatggccgaataacaggtataaaataaaccctaaaatgggaataaaaaaaagaaccaagagccaagcccatgaagcgctggcatcgcgtctttctttgaaaatcatgatgacggccaaaagtatatttaaaacgaaaaaaaatccgaataaaataaatgaaatgctcactttgcaaccccgctatatcatatttatcaagactgtgcccattagtattccgacaagtgcagcaatctgattcccatttcaaattataacattgacattttgaaagaataaagagccggaatcaaagatgaatgcagttttctttcaaagaaagttccgagtgcggtaaaatatgcatatatgaaaaagaagacaaaaatgacagcaaaggggagagggcatgaagctggagcatgcggaacaattgccgggattcataaaaaaagaaattcagaaaatacaaatcgccatcgcgccgctgatgaaaaaaagcatcatttaccgttttcttgctttcccgctcgccgcttttagtctgtttcatctggcatcgcttttgattcaggccccttccgggagaggagctctcgtatcggccggcatttttgccctccttgcggctctgggtcttgcgttttttaaggaagccggccatcagcggaaacaggtgcaaaaaacgatccgcctttatatgctgaacagaatcagaaaaagcgacattctgtccgaggaacggaaaagcgcctatacccggctgattgccgaggagccgtctgcgatgaagagctttattgaatttttaacggaagaagaccggaaaaaagaaatgctttattaaaaaagagctgacacgcgatcagctctttttgtcattcaaacaccgggtcgttctcatagtaatatgaatcaggcgtgtcatacgtatcagtgctgtgataagcgataattccgatgacagcgaagatgacgactaaaataaaagcgagaatgcccaataccacactggatgccgcgtaaaaaaactgcattttgataaatgacgcgtaatgtgcaagcatattttcttccgcgttttcttctagtccttcctgaagggcggcagccgcttttgccgagcgcatcagcatgacgccggaaatgatgagcagaacccccggaatggctccgagcagtgtcacaatggctgacagagcggaaagagagcccgtgatgatcagaaacacggcggtgatctttccccatttggcgatgtcggcaagggaacgggcttttttattgagcggctggttttcgtctttctctttatcgatggtgatcatgacagttctctccctaaaatgttcaagtcatatcgttttccgtccatttcggcgatacccgggaatacgccccattcggtaaaaccgaatttttcaaacagcttaatgctcggcacattatgtccgaagataaaagccatcaggctgcggatgccgattgccggagcgagtgccagggcttctttcagcaaaaagcttcctgctcctttgccgcggcaatcctgatgcagatagatgctgatctccgccgttttgtcataggccggacggccgtaaaacgtttcaaagctgatccaggccgccactttgccggtttcatcttccgcgaccatcagcgggcgccggtccgtgtgccgcaaaaaccaatccatccggtcttcgggcgtcacttcttccgtatcagccgttaccattcgtgaggcaatcgtcgagttgtatatggccaccaccgcatctaaatcctccaatacggctttgcgcagggtcaaattcatattccgggatctcccttcacattttattacataatcaagtgcaatctgcacatactatttccaaaaaagttttttatggatgtgtatatattttcagaaaagtgttcagaatgttgctgaggtgatgaacaaatgagagaggaagaaaagaaaacttctcaagtcaaaaaacttcagcggttttttcgcaaacgctggatattccctgcaatctacttagtcagtgcggccgtcattttaacagctgtcctttggtatcaatccgtttcgaatgatgtgaaggacaatctgacgaacaacggaggaaactccgcgtatgacagcggcaaagacgatgccgtcgaagtaggcaagtcaatggaaaacgtcgcaatgccggctgctcattctgaaaatgtttctgttgtgaaaaagttttatgaaactgatgccgcaaaaaaagagaaagaagcagcacttgttaactataataacacgtacagcctcagtaaaggaattgacttagctgagaaagacggaaaatcatttgatgtttctgcttctctgagcggtacggttgttaaagctgctaaagacccggtactgggatatgtggttgaaattgaacactcagacggcctgtctactgtctatcagtctttatctgaagtcagcgtggatcagggcgacaaagtaaagcagaaccaggtcatcggtaaatccggaaaaaacctttacagtgaagaaagcggaaatcacgtgcactttgaaatccgcaaggacggcgtagcgatgaacccgctcaattttatggacaagccggtaacatctattgaaaaagcggcggctgaagagaaaaacgctgtgacagaagaaacggaagggtcaattcagcagtcttccgagaaaaaagatgtgacgcctaaaaaagaaaccgaagaaaaaccaggtgacaaagaggacggcacaaaagacaagacagatggtaaagatgacggctcaatgaaagattcgggcaagtaatcttgatcccaaagcgcctatcagctcagataggcgcttttcatattgccgcatgtgcctttatactagtagaaaacgaaggagatgctgaatgaataaatgtctggcggccgggtggctcgtctttgttttcgtttcggctttgacggaaagctttcacgatatgattgtgtcacagacggtgtccttccgtttcacgccgcatccggatgtgtccggtttctttgtgttcgatatggcggagctcgccataccggaagcggcgattcaaaagctcgggcacgcgttttcattttttgtgctcgcctatttgtttttcagagagcgcaggcgcatgaagagggcggtgctgtatgcattggccgccgctttcctgacagaaatcgtccagctctttttcggcagaaacggatgcctccgcgatgtgctgattgacagtctcggcattgccgcattctgtgctttacaaaggaaaaagcatacagccaaacatacaaaaaccggcagtctgtgacagacgccggctttttttatatattatggtttgtcgatttgcttttatgaacgatactttcatagattcgcacgatcagatcgacaatcggacgaagcacatttgaaaatctgaacagcaggaatccgacaatgagggaaacgataatgcttccgagcacatcgatcggataatggtggccgacccaaattcttgagaagccggtcaaaaggccgaaaatcacaagcggccagccgagttttttgttgcggaacagaatcgcaattgaaatcgccaaagcgcctgtcgtatggtcactcggaaatgaagcatccgcggcatgagggatcagcgtatgaaccgtatgttcgacaaaggggcgcggctcgacatagactttcgtgatgaggtagttgacgataagcgctgcaacacccgtgaagcccgcgtacagggcgttttgtctgccttttgtgcttccgaacagccacatggcaagcaggaaaagggcgtaggcgtaaatggcgtattccgtaataaataccatgatagagtcgagaatggcactatggtgcgacaaaccattgatcgctttaaatagttcgtaattcacaaatatcaccttttatctttattttatatgaacagtgtaatgcttttttctatgagacacaattggtattaaaaataatcataaaaaagtaaacagaatgaaacgtgactgtattactgtgcgtcaagtatgcgggaaaagaatagccgaaggagttttgtccgttgctgaaacgtttgaaaaacgccgatctgccgcttgtgtttgtcattatgctgctttgcggattcggcttgttaatggtgtacagcgccagtgatgtgatggggtctcagcggtacggagatccatcctatttcttccataagcagagtgcctctttactgatcggattatgcttatttctatttgccgcctgtctgccgtataagcggtatgcgcggcttgtaccgctgtttgtggtcggttcgctggtattgctgctgctcgtattgataccgggaatcgggctggagcggaatttttcccgcaggtggctgggagcgggcccgcttgtcgtacagccgtctgaattggcgaagatcgcgatgattttgtatttcgcttcgatttatacgaaaaagcagccgtacattcatcaatttgtgaaaggggttctgccgcctttagtgattttgggaactgcttttctgctgacattggcggagcctgatttagggacggcttccttaatcctggcggcgtgcgggtcgattttattatgtgccggcttgaaaaagcgccatctgttcgtgctcggcgcgacggcggtgtcgggggttgtttatctcgcattttccgcttcctatcgtgtgaagcgcctcgtttcctttaccaatccgtttggtgacgcgaatggggacggctatcagctgattcaatcctattttgctatttccggaggcgggtttttcggaagagggcttggaaacagtgttgaaaaaatgaactatctgcctgaggcgcataccgatttcattatggccgtgatcagcgaagagctggggatattcggtgttctgatcgttttgggattatattttgcgttaatgcttctcggcgtaaaaacggccgtgcgggctgatgacccgttcgggaagcttcttgccatcggaattacgtttcaattaatgtttcaggttgtattgaatttgggagcgatgagcggacttctcccggttacgggtgtgccgcttccgtttatcagctacggcggttcttcattaattatgacgctgtttttgtgcggcatactggtcaatatcagtacatatgcgaaaaaacaacccgtacggcataagcggcctgtcccgcatgaaaaaaaggtttcttctttttaatgaagctggaaaaaacgcccgggacatttctgtctccgggcgttctgcctgtttataaagctcctggtccttcttctccggtgcggatattaatcgtgtttccgatttcatagacgaatattttgccgtctccgggctctcccgttttcagcacttttttcgccgtttccacgacttgatcaacggggaccttgctgacaacgatttccactttcagccgttcatacacattgctctcaattttgactccgcggtacagttcggtgtgggctttttgaaggccgcagccgtgtacgttggagaaggtcagcgatgtgactccgattttaccgagttcctgtttcaatgtttcaaacttagccggacgcgtaacgatttctaccttgaacatttgaccgctcatctaagccactcctcactttataagtcctgatatgctttttccccgtgcatcgttaaatcaagcccaagtgactcttcttcttcactggcgcgcaggggaatgaacagacctacaattttaatgataacgaaagtgacattaaatacaaatacataggttgccgcaatggccgcaatctgcttccagagcagtcccggatcgccgtaaaacagcccgtttgccccgccgtcattgacggaagtggtggcgaataaaccggtcgcgatgccgccccatgtcccgccgatcccatgcaggccgaaagcgtcaagcgcatcatcataaccgaaagtctttttgagccaataaacgccccaaaagcagacaagcccgccgatgaaaccgattacgatggaagagaatggcgtaacgaacccggcagccggcgtaatggcgacaagcccggcgattgcgcctgatacagcacccagcatggtcggttttttattcagcatccattcgattaaaatccagccgataattccggctgcagccgcggtgtttgtgttaatgaaggcaaacatcgcgatactgtcaagcgtgagggcgctgccgacattgaagccgaaccatccgaaccagatgagcgctccgcccaagaacgtgtaaattaagttgtgaggcgaagcagccgtgccgtccttgcgtttcccgagcacaatcgccagcacaagcccggcgactccggaagaaatgtggacgacgtttccgcctgcgaagtcaagagcgcccatttggccgatccagccgccgccccatacccagtgcgcaacgggcgtatatacgagggaagcccataaaaaggaaaatacaagaaaagcactgaatctcatgcgttcagcaaatgctccggaaataatggccgtcgtcagtacggcaaacgtcatttggaacatcatgaacaaggaatgcgggatcgtatcactgtaacttccgggttcaaagccgacccccttcagcccggcccattcaatcccgccaagccatgtattgccgggggcaaaagcaagtgaatatccgtacaaaacccaaacgacggatacgatggcgagagaagaaaaactatgcatcgccgtgctgagcacgtttttgctttttaccattccgccgtaaaacaaagccagcccgggggtcatcagccacacgagtaaagcgcaaaagaacataaatactgtatcgcccatctgcatgttgtattcctccgtctcattcagaatgtaattgtgattaattcattattatagagaaaaaagaacgataaaacattttcatgtaaggttatctgacatggttttttgcgttcataatgctgctttttcaaatgggtgccgtgcgactttatatccataaaaagagcgccggagcacggcggaagaaatcctgtccgggaaagagtaaaataaacggggtgagaaacactaactgcatcaggaggaatcattatgacaacatcattaaatctgcaatttgaaaaaacggctttggtccttattgatttacaaaaaggcattgtgccgatggataaaagcggtaccgttgtgccgaacgcgaaaaaattaattgatgtgttccgggaaaaaggcggatttatcagctttgtgaacgtggattttcatgacggagcggatgcgctgaagccgctgacggatgaagaggcggcgggccattcggctccgccggcggactgggctgaatttgtgcctgacatcggagtgaaagaaaatgattatacggtaacaaaacggcagtggggcgcgtttttcggcacggacctggaccttcagctcagaagacgggggatcgacacgattgtgttatgcgggattgcgacaaacatcggtgtggaaagcacggcgcgagaagcttttcagctcgggtatcagcaagttttcgtaactgacgcgatggcgacattcagcgatgaacagcacgaagcgacactcaagtttatcttcccgaaaatcggcagaagccggacgacggaagaatttatcacacagacaaaatgacaatctccaaaaaaagccgcgtcctgttcttgacagccgtggcttcggggacgatgctgaacccattgaactcgtcgatgatttctcttgcgcttcacagtattcagcatgaatttcacctgtcgtttacaacggtgtcctggctgatatcgtccttttatctggccagcgcggtggcgcagcctgttaccgggaagctcggtgatatgctcggcaggaagaagctgtttttgatcgggcttctgcttgttgctgtctcggcggtcggcgcgccgtttgcgccgacttttatgactttgctgatcatgcggctttttcaatcgatcggaagcagcgcgatatatccgtccggcgtcggattgatccgttcaaatatacgggagaagcaggcttcggcgctggccgtcctgtcaatctttgcatcagccatgacggcgctcggtccgactctcggcggttttctgatcgtttggggagggtggccggcaatcttttttgtcaatctgccgtttatcattctcagcttttttctcggaatgtatatgtttccgaaagatgaaaaacgcgagatcggcggcttgaaaggcgtgctccgccagcttgatacgatcgggatactcctgtttgccggagcgattatccttctcctgtcgtttttattgtccttcagtacgaagcctcactatacagaaggcgtattcgggcttttgtttgtcgggctctttatctggcgcgagctgaaaacagagaagccgtttattgatgtcaggctgtttaaaacgcatcggaaactatcgtcggtgtatattcaatttattttgctgaatatattcttttactgcatctttttcgggcttccgagctattttcaggatgaaatgcatttgtccgttcagacaagcgggttgattatgctgtttatgtcgggcatgagtattctggtgtcgcctctgaccggaaaatggatagataagaaagggcttcttcagccgattgttgccggaacctgcctgaccgcgatcggagcggtgctgttaacgtttttctttcttcaagcgcccatgataggaaaagggctgatcctgtccgtgctgggtgtcggctacggcttcggaaatgtcacgtttcaggcggccatgctgacaacgagccccgccgacatggtcggaacaacgtccggcctgtttcagacctgccggtatctcggttcgattttgtcttctgtcattttgggcattcttttcggaaaagaaattaccgccggccattttcatatgcttgggacgattcttatcgttgtcggcgctgtaagccttttgatggcgttccggttttcggttctcctcaaaaaagcctcttaacaggcgcaacaaaaagagacgggctctccccgtctctttttttgtgtaatgtgctcaaaaatcaaaacgattattgtcgatagcgaccaatgttatttacggaattttcagttatattttttcacatgtgatgtaaggaaaacgtacatgcgggagggagaaaatgaaaaaaacaacgagtgatcggctaagcaataaagatttactgcctttagaagacggcgaacggacatggaaagcggtgaattttgcatccatctggatgggttgtattcataatatcccgacctacgcgactgtgggcgggctcattgcgatcggcctttctccgtggcaggtgctcgccattatcgtgacggcgtcactgattttgttcgccgctttggccttgaacggccatgccggaacgaaatacggcctgccgtttccggtcattatcagggcttcttacggaatatacggggctaacattccggcgcttctcagggcgtttacagccatcatgtggctcggaattcaaacatttgccgggagcacggctttgcacattctgcttttgaacatatggccgggctgggggagtctcggcggagattggaatatactcgggcttcatctgccgggttttctgtcgttcattttcttttggggcattcatctgcttgtactgcggcacggcatggaatcaatcaaaaaatttgaagtgtgggcgggcccgcttgtttatctcgtcttcggcggcatggtctggtgggcgatagatattgccggcgggctcggaccgatttactcacagccgggaaagttccacaccttttctgaaacgttttggccgtttgcagcaggggtgacgggcattatcggaatatgggcgacgctgatcctgaatatccctgacttcacccggttcgccgcgtcgcaaaaagaacagattcgcggccagttttacgggctgccgggaacgtttgcgctgttcgcgtttgcaagcatcacggtgacatccggatcacaagtagcattcggagaaccgatttgggatgtggtggagattttggcccggtttgataatcctttcgttatcgctctttcggtcatcacactttgcatcgccgccgtctcggttaacgtggcggcaaacatcgtgtcaccggcctatgacttggcgaatgtcctgccgaaatatattacattcaggaggggagggtatctggccgccgttttggccctgttcacaataccgtggaagctgatggagagcgccacgaatgtttatgcgtttctcgggctcatcggcgggatgctcggaccggtggccggggtgatgatggctgattattttatcatcagaaaaaggcagctctcagttgaagacctttattcggaaaccggacagtacacttattacaaaggctataattaccgggcctttgccgcgacctttctcggcgcgtttatttctttaatcgggatgtacgtcccggcgttcgccggcatctatgatatctcctggtttgcgggtgtcattttgtcatgtctcggttatacggcgcttatgtatattcatcctccttatgtaaaagcggcaagacgaatcgcgcgggaaagagcggccgaataaaaaaagccgggggctgccccccggctttttgtcatatcattctgcgattgaaacgtttccgtccgcttgaagcggcgttctttttttctggctccagccatacaggagtaaagcaatcaggacgaacagccccgctgccagataaatcgaatggaatccggccgaagcgacgaagaggccgaatacatatgacccgccggcaatcccgctgtcaaagaaagtgaagaaggtagccgtcgcaaagcctgaacggtgtccgggcgagttctgaatcgccagcgtctgcatacacggtacgatagagccgtatccgagaccgattacggcaccggacaagagaagcatgagggcgctgtttgtcatcgccagcatgcaaagccccgcggagaacacgataatcgacggatagatgacgattcccggccccactctgtcaaacagctttcctgtgaaaggacgggcggccatcatcgtcactgcgaaacagacgaagaaatagccgctgacatccaacaggtggatcgtctttgcataaacggataaatatgaagtcacacttgaataacagaaagaaatggacaacccgacaatcgcgattttaagcgcgcctttttcaaacatgtcggagaaagaaaaacggaagacagtcgttccgctgttgttttgatccggcacacgaatcataaaagcaatcagcaagcctaaagaaacaaatacggcaaaaatcgtaaagaaaaccgggaacgaaatgactttcacaagactcagtccgagaaaaggaccgatcgccatggcaaggttcatagacatcgcaaaataaccgagcccctcgccgcgccgcttggcaggaataatgtcagcggcaattgcgcccgtgaccgtcgttaaaatgctgaaccagatgccttggaaaaaacgcagtccgagcagcagatagaaattgtgtagcggcaaatacagataagaagacagggcgaacagcgccaaggatacaatcgtcattcttttcttgccgaaccgttcaataatcgcccctgaaaaaggacgggtgataatagcagataacaggaacaggctgatcaaaagccctccttgcgattcactgccgccaagctcctgaatcatatagataggcagcacggccaaaaatgtataaaagaacacaaagacaaataaattcacgagtacgaccataataaaatctttggtccagatcgagtcagatttactcaaaagtacagcacttccctttcttttctatttcgttaaaaacacattcagaaactcagaaaaagcttccttatctccatcttggaaatccgcaagcatgtcttcctcgaacttcagcatctcttgattgatgctgtcgtatttcaattcagcttccttcgtcaggacgacgagcttttcccgcttatcttctccctgttcccgctgaatccagccgttttcttcaaggcgtttgatcgttctggtaacggtcggcgcctctacgttcagataggaccagatttctttttgggtcatcggtccgatcgtttttaagcaatataggattgaccattgagaggagtacaggccgaatggttccagccgttcattggctttcttcgtaatcaggcgggcgcattgattgatttggtgaatgaggcgtctgttgacgtggatcatttccgttctccttttcaaaaaacttacctaagtaactaattgtgctgtttcattctacagcaggatcgcgcggatgtaaaccccccgatcaaaaagcagaaaattatgacccgccccttgtccttattgagtttttagcatattcccaattcattgctaatacactgttacaaacctatcaaagagagtgtttgaggtgagggatcgtgggcatatttctaaaaccttcttatataatcggacaacgaagaagctgcatcatcagtgaatctgttacagaatacggatctcatttcacacttctcacatccaactggggaggtcgagtggtgtgcacgattacatcaaagagcgaacaatcaagattggtaagtatatcgtggagacgaaaaaaaccgttcgtgtcattgcgaaagagtttggtgtttccaaaagtaccgtacacaaagatctgacagagcgcctgcctgaaatcaatcctgacttggcgaatgaagtaaaagaaatactcgattatcataaatccatcagacatttaagagggggagaggcgacgaaactaaagtacaagaaggatgaaattcttgaaggggagcccgttcagcagccgtagcgtctgacgtctgccgggcccttttttctcctcccgggcggtttcgcgaatatccgcaaaattttgtcaagaacttatatcgttcagcagcttttttttgataaattatgataatatatataattagggcacaatgtggatattttactgtgaaacagatatcaaggaggatataaatagatgtttgcaagggatattggaattgacctcggtactgcaaatgtactgatccatgtaaaaggaaaaggaattgttctgaatgagccttccgttgtggcacttgataaaaacagcggcaaagtgctggctgtcggtgaagaagccagacgaatggttggacgtacacctgggaatattgttgcgatccgtccgctgaaagacggcgtaatcgcagacttcgaagtaacagaagccatgctgaaacatttcattaataagctgaatgtaaaaggacttttctcaaaaccgcgcatgctgatctgctgcccgacgaatattacatccgttgagcaaaaagcgattaaagaagcagctgaaaaaagcggcggaaagcatgtgtaccttgaagaagaaccgaaagttgccgctatcggcgcgggtatggaaatcttccagccgagcggtaacatggttgttgacatcggaggcggtacgacagatatcgcagttatttctatgggcgatattgtcacctcctcttctattaagatggctggggacaagtttgacatggaaatcttaaattatatcaaacgcgagtataagctgctgatcggtgaacgtaccgctgaagatattaaggtgaaggtcgcaacggttttcccagacgcacgtcatgaagaaatcaccatccgcggccgtgacatggtttccggtctgccgagaacgattacagtaaacagcaaagaagtagaagaagcccttcgtgaatcagttgccgtcattgtgcaggccgccaagcaggttcttgaaagaacaccgcctgaattgtccgctgacatcatcgaccgcggcgttatcattaccggcggtggagcgctgttgaacgggcttgaccagcttcttgccgaagagctgagggtgcctgttcttgttgctgagaacccgatggattgtgttgcggtcggaaccggcgtcatgctggataacatggacaagcttccaaaacgcaaactgagctgatgataaaacctcattctgaaaaagaatggggtttttttctgacaaacccttcacgaacgggaatgtaaatccgataataagaaaaaatgctgattttcattatagaacaaatgttccggtgaggcaactggaaataatgctatttcagaggtggaagacttgttaaaaggattatataccgcaacgtccgcaatgattacacagcagagaagaacggaaatgctgtcaaataacatcgcaaacgcgaatacgtcagggtacaaagaggatcaaggttcaatccgcgcctttcccgagatgcttctgagccgaatagaaggcgacaaaaaaacgaaaatcggctccgtcaacacaggcgtatacatgcaggagctgaaaccgttgtttacgcagggaagcctgaaaacgaccgatcagccgacggatatcgcgcttatggagaatcaggttcccaagaatgccgaaacgaatgaaaacgccgagctgttttatcccgtgcagaccgcaggcggcgtccgctattcaaaaagcagcactttctcattaaatgaaaacaatcagcttacgataaacggaaaccttgtgttatcaacaaacggacagccgattacagtcgacaatgaaaaattcaccgtatcagaaaacggaacggtcacgacaaacggccggccggcggggcagattgatatcagaatggaagaagacgtgcgcaatctgaaacgggacggcaatgacctatacagcacggccgacggctctgaactgccgagcgcggcggcgaatccccaagtctcgtattcattaaagcaaggcgtctcggagctttcaaacgtggacgtgacgagcacgtatacagagatgacggaagcatacagatcatttgaagccaatcagaaagtcattcaggcttacgataaaagcatggataaagccgcaaatgaaatcggcaaagtgtaacaaaatgggggacattcaattatgatgctcagatcaatgctgacggcttcaacagccttacatcagcttcagcagcagatggatacagtcagcagcaacctttcaaacagtgatacgacaggctataaagcgagggactcccgcttttccgagctgatcagacagcagtatgaccacatagatgacaaaaaggaaaattcgccgaacatgcggaaaacgccgcccggcctgcgtctcggcgccggaacggtgatgactccgcagctggactcagggcagggaagcatcaaaaaaaccgaccgtgaccttgatatcgcgttcacatcaccttatcaatatcttcaggcagaagcggacggacggcgggtgtatacaagggacggctcactttccctcaagccggccggcggaaatgaccggctgcttcagctgatgacagcgggaggcaatcccattctcgatgagaacggtcagcccatacaaattgacagttcgctgactcagctgaaaatcagcaaaaccggaacgctgactgcttcggaccaggcgggaacccgttcgcagacgtttaatctcggcatcgtcaatgtcaataatcctcaggcgcttcatgcggaaggggataatctgttttccgtaaacggcgcgggggcttcagcgattgaagagcttaccggcgcaaaccggcaggcaatcggtatggagcagggcgcgcttgaaagttcaaatgtcgatatgtcaaaagaaatgaccgacttaatcgtgtctcagcgttcctatcagctgaacagccgcacgattacattgggagaccaaatgctgggcttaatcaactcagtgagataaaagaaggggcgttttgatcagccgcgcatgataaaaaatgcggctttctcaaaatcgcccttttttttgtagtaatcagtaatatcctgaagcagcacttccaaatccacccacgcttcaattttctgcaactccagcacaagcttctgcaatcggtcgtacgggtcctcctgagcggtgtacagtatgttgagcgcggtcagcttcaatttcataatcttgttctgcactttttcagatatgtataatcctttctgcagcacggtttgtccttcggcggcagagccggttttaaaaagtgctctgaccgcttcgtacacacaatgaaggtaggaaacgggagactctttctcgaaacgctgattgcccaatacctttttgtaaaaagggagggcctctttatcttttttctgggcggtctttaaaaaaccaaaattataataggcgtggcacagcaggttattgtcattgatccggtccgttatctttatggattcattgaagagctgttctgcgtcgtcatagcgtgcctcgtctatataattcacggcgagaagcagccggcagctgagcgtttttttgatgtagccggcttcatcttgatagatttccagcgctttattgacatattgaatggagagcgcaggcgacttcatcatgtaatatgcacccgctgttttataataaaattcagcggcttcgaaacggtcctgaatggccggcaggtactgttcagcttctttaaagcggcagacagcacggttcggagcgccattcaccatatggaataaccctttgaaaaaatagaaataataagttaattcatgatccatctcatctttgcgccgcttcagctcgcagaacagcttattcagaccgtcttttttctcaaacagcagctgaaaccgtgcgaaaaacagctgatatctgagtttgagctttgcattcttttgtaatttggggagatgctgattgatttgttcgtgaagggaacgggctagatcgaattggcgttttcccatggcgtcataccactcattcagcatcaccagcgtacgtttttcagtaaacttagcaatcatcttccaacctctttgcatagggtaaaagtctttatttatcataacacattaatggacgaggctcattgccagctggttacagtttacagcgcggttgaaaaagaaattgattcataatatacttccaaatgtacagattggtgccacatatgccttctatacatactattgtcgatgaaggagatgtcaagagaatgcttgatactcagcaaattaaagaaattattccccatcgctatccgtttcttctggtagacagaattacggaagtcgaagaaggaaaacgggcggcgggatataaaaatgtgacggcgaatgaagattttttcaacggccattttcctgaataccctgttatgccgggcgtattaatcgtagaggctttggcgcaggtcggagcggttgcgatgctgattaaagaagaaaaccggggcagactcgcattttttgcggggattgataactgccgtttcaaaaagcaggtaaaaccgggtgacaagctggagcttgaggttgatattacccgcgcgcgcggtacgatcggacgcggcaaaggcgttgccaaagttgacggcgagctcgtgtgtgaagctgaattaacttttgcgctcggagaataaaagcaaacaaatgggcttataaaaaagcccattttgtatagaaaggggtgaatgtgatgtggtcagaatttaaaagctttgcgatgcggggcaatatcatggatctggctatcggtgtcgtcatcggcggcgctttcggcaaaatcgtgacgtcgctcgttgaagacatcatcatgccgcttgtcggcctgcttcttggcggtcttgacttttcaggactggccgtgacattcggcgatgctcatatcaagtacggaagcttcattcaaacgattgtgaacttctttattatttcattttctatttttatcgtgatccgcacaataggcaagctgagacgtaaaaaagaagcagaagaagaggctgaagaagccgaggaaacagatcagcagacagaactgctgactgaaatcagagatctgctgaaacagcgggctcctcacaatgactagtgcacaaaaaaaggctggatgattaacgtccggcctttttcatgatcataatttttgtttaaacgcttcaatcagccggctgcccgagtagccttctttcacgagcgactccagaatgctttctgatccggggtggtttcttgacaccatttgaccgtaaattaaaacttgtatacttctttccagctcgacgatatttttgatgcttcccgtcagctgggcggggcggttgctttttttcgtaatcgttacaaacaccttcgcttctttctggcttttcatcagcatgtcaaaaaaagacaagtgttcggccgggaccagtgcttcaattaaccagtgattttctccgtcctctttattgataatcaatccgtctaaaaggggaaactgctcaatcggctgatcgtctttatctaaacgttccacattcagatcaaccagtttaaaggttttcatctcttattttcacccctgttgtccatgtttttcgttcatttattataacacatatcatttttcccgggaaaatgctgtaagacatgcttcatcatttttgtaggcggtcaacatttaatcatttctattttttcattataatgtaaaagaatatggtcatggagagatgcttatgaatcaattgcgcctgaaggaaatctatatagaagacggttcaaggcgaaaagacgatcattcctacttggtatgcaaaaaggaagattgtgaggtgcatcttaacagaaggggaaatgtcgtctttttatatgaaacaaaagaccgcatggaacagtataaaattcagctttcactgactgataaaaagctgagtttttactggttcgcatgggacggcggaaagtttgtccgcatgtttgagaaagactggctcaaaacgaaacttttctcgcggctgctcaaaaatacatattacataagcggccaaaaacaaaagttttttttatcagaaagaaaaacgaaaacataagagcagcctgaacggataacggctttatccgctttttgctttcacgagcccttgtactacaatgaagccagcctcgaaaaagagaggaggatacggcttgtttaaccacgttatgcttgtcggccggctgacgaaagacccggagctccgttttacagcagcgggcattcccgtcgcgcatattacgttggcggtaaaccgcaattttaaaagcgcgtcgggtgaaaccggaaccgacttcgtcaactgcaccatctggagaaaaaacgctgaaaacacggcattgtactgccaaaaagggtcaatggtcggtgtaagcggcagaatccagacaagaagctatgaaaagacagacggcgtaaaagtttatgtgaccgaggtcatggctgataccgttcggtttatggatcaaaaacagaaagagcaactggctgaatagcattcttttttcctcgatttcccgcctttcagcgggccccgcaatacctccttcccactcgccagtcgaaagactggtttttttgtgcgggagctaaaaaatggttaaaaagaagtgatttcgcttatgaatacttaaaaacattgaatatattgggataaaaacttataattacttacagataagtgacgaaaaagggaatgaggacgtgtatcaagaagaaagactgattgcgataatggaatatttgaaacagcatcggcggatcaccgctgaacagatatgttcgctgcttcatatttcaagagataccgcaagaagggaccttgtaaagctgaaagagcgcggggccattatcagaacacggggcggcgcgattctgccgtcggtgaatcaggaggttcctggctattcgggccggctgaaaaccgtttctgaagagaaaaacaaaatcggcaagctggccgcatccctgatccataaaggagaccggatcatcctggacacctcgacaaccgtgcaggcctgcgcggagcatttaaatgtcaccggctgcactgttattacaaattcgatcaatcaggccgatatcctttccgcaaaagagggaattgatattcacctgctcggcggaaagctccagaaggaacaccggtttttatacggggcttccgtcgtagaaaaactgggggattatcacgccgataaggtgctgatcggcgttgtcggcatctcggaaaacggcctgacgattccgcatgaagaagacggcatggtaaagcgtaaaatgatccgacaggcggaacaggtgattgcgctgagcgatcactccaagcttggccgtacgagtttttatcagtatgcagctctgcatgagattgacctgctgattaccgatcagctgcctgatcaggatttttgcgatctgctcgaccggcacggcgtagaattgcttgtaactgaatctgaagaagaggatgaggacatgtgaaactgattgccatagatctggacggcacactgctgaacagcagtcatcaagtaagcgatgaaaatgagcgggctttaagggatgcccggcaagcgggaattgaaatcgtggtttccacgggacgcgcgcattttgacgtgcactccatattcgaaccgctcggcataaaaacatggattatcagcgcaaacggagccgccattcatgctcctgacggcagcctgtaccactgtgatgcgattgaagaaacaagagcccgcggcattttgtcatggcttgaagagaatcaatattactatgaggtgtttacaaacaaagccatctatacgcctgaaaccggcaggcagctgctcgatatcgaaatggaccgggtgaaaagcgccaatccggaaaccgatctttccgttttggaacaggcggcttcagtgcaatacagccaatccggctttgcttacattcattcataccgtgagctctttgagaaagaagagcatctggatttttataatattctcggattttcgtttgatgagcggaagctgaaagcgggctgggaccgattcagcggtcagaaagatctcacccttgtcagctctgccgatcacaacttcgaactggcgtctcgaaacgcctccaaagggcaggcgctcaaacggctggcgcaaaagctcggcattccgatggctgagaccgccgcggtcggtgacagcttaaatgactattcaatgcttcaggcggccggaaaaggcatagcgatggggaatgcgagagaagatattaaggagatcgctgatgccgttacattgacaaatgatcaaaacggcgttgcgcatatgatcaggaatttactgtgaaaggtatggcgatactgttcatgactggcgtgacgcattcatggcaaatgcggcgtaacagtaaggacgacataaaagaccggctcttctgagagagccggtctttttgcgtttaatgtgattgcgccgatgcgctgagggtgaataattcttcaagctcagcggatgacagctcggtaatccaattttcactttggataatctgatcgttcagcgtttgtttcgtttcgagcatggcatcaattttttcttcaatcgttcccgtcgtaatgagtttgtgaacgtggacgaaccgttcctggccgattcggtaggcgcggtcggttgcctggttttccaccgccggattccaccatctgtcatagtgaatgacatgattggcagccgtcaggttcaggccggttccgcccgctttcagtgacaaaatcagcgtcgggtattctttcttctggaaccgttcgacgagagaatcgcgttcctgcttggataggcttccgtttaaaaactgaaccggttctccgaatgttttttccaggaggcgcttcatcatattgcccatctgaatgtattgggtgaaaatgaggcagctttccccttgtccgcggatcaccgccattaaatcaagcagcttttccagtttgacggatctcccgtttaacagctctgtctgttcttccttcaaatagagcgcaggatggtcgcatatttgcttcaagcggccgagcatgctcagaatcagcgctttccgctgcatcccggtcagagaagccatatgttcaaatgtatctttgacaagctgttcataaagggatgcctgttcggctgagagcgggataaactctttttgttccagcttgtcaggaagattaagcgccacttcttcatcccgttttgtccggcgcagtaaaaacggccggattaactgctgaagctggttgattcttttttcgtcacggtctttttcaatcggcagcacatagcgtttatgaaagccggtcagactgccgagatagcctttgttcataaaatcaaagatcgaccaaagctctgtcaggcggttttccatcggtgttccgctcagcgcgatatgatggacgcctttcagctttctgatcgcgcgggactgcttcgtatgcgcgtttttaatattttgcgcttcatcaaggcagatggtgctccatgtcacggaagaaagctcttcctgatcggcgtgcgacaggccgtaagaagtaagaacgacatccgcgtcctgataggccgggacaaatgcttcccccttcggccggcgggggccgtaatgaagcacggcctccagctgcggcgcgaaggtctggagctcacgctgccagttgccgagcaccgatgtcggcgcaatgattaaggcaggcgctttttgccggccgctttccttcacatggagaaaataagcgatcatctgaatcgtctttcccagtcccatgtcatctgcgagacaggcgccgaagccgttttcccgtaaaaacagaagccagttcatgccgtacatctgataagggcggagctggccctgaaacgcggcgctgacttcatgctccggcagatcccgggcatccgtcagtttgcggatcaggcttctgagctgctttgataattcgatcttgatcccggcaaatgccgatgagtcaatgaggtccgtgtcctcggctccgttttccccgtgatccatcagttcgcgcgccagcacgtcggacatgtggaggccctcagattctgctttttccatcagttttttcatttgtttaatgaattgaggatcaattttcacccattggccgcggatgttgacgagacgtctgttgtttgcgacaagctcattgaattcatcctctgtcagctcaattccgtttgtggcgaatctccagttgaaatcaagcagagcgttcatgccgacgaaggactcgccccgcggcgaggatgacactttcgccttgagcatcatattgctgtcccggacaatctgccaccatgatgggagaagaatctccacacccatatcgacaagcgtctcactcgcttccgataagaagatccaagcctcttcttcagaaatcagcgtcgttcctgaatcaaacgaaagccagggaaccgttctgcggaagcggtcctgttcgcgcgcgatttttccgctgtatgcctgccacgcttttttcagtcccttcagtccgtcaaaaaaggtgatggagccggtttttttctcacgtaaaaacatttcgattttccagtcgtcaccgtcgaaatcaggctcgtttaatcggagcccgacggtaaacggcgtcagatcgtcatgccagccgattccctccagaaaatcatcttcatccaaaaaggagcctttaaacgtatgaacggccggcgagcgggtttcgatctgccgccatttttccagcaggtcatcattgtactgaatgtagtcctggaccgcggctgagaaccagtctgccgtaaagccttccagcaaaagctcgcggtctttgaagcgcaggacgccattttgccaagcctcataatccggaagaaaatcgccgtcggcaataaattcgtatatcgtcgaagccgcttcgattaacggttccgtttcctttgtcagctgcacggtgctgaatgaattgaacgagttttttccgagcagctcgacggtcatccacgggctgagcagaacggccggggtgccgatgaagctgacgtcttcaagaaacgttccgtaaaaggttgactcatgccattggaacaaatgagtcttcatctgactgagagtaagcggctgctccttctcatcatggcttgacagcgtaaatgtccaatcttccatttgttctacatgaatgaaaatttccttaagactcgccatcaatcaactttcctttctgcaattcttcttgaagggcgcgcagcctcttgtagcttgcgctcagccggctgatataccgctcccatacctgctgtttctttgcctttttataaagcgtccgcagttttttcagatggcgcgcagcctctttataggcgctgcggtttttttggtcgataaaaaaggccgccgcccggtgataggaggggatgagcgcttccggatcactggcggcaatttcctttaggatgtccttttcgatttcccagacggaaaaaccgacgaggctgtgaatctccacccactccgcgtaccgccgtttttcgtacaggtactggctgtattcggtaaaggtatagggaaggcagccggaagcaaaccgttcaaacagctgatcatcccgtgagtgccgcgcataatccgccaatagcgcaaacagctctccgataatgtcgcgcatttctttaaacggcttatcaagcttcgtatagttcacggcaagcggttcgatccggccataccaagctttcagccgtttccagtcttttttcgcggtgagttcaccgagccattgaaaggtatacggcagcgcttcaggagggaagcgggacatatcttcaaagacagattcatcatctttttgcaaaaaggccagatgaagccgtccgaaccgcacttccggcgaaaaacggcgcccgctttcctgttcgagaatctcctgttcacgcgcaacccatttcggccggttcaaaagcgcgctccacatctcaccgaatacccggaggcgttcgtattgaaaaagctcttctttcacaagcagtctgcggagcaccgggggcgtccggtctaaaaagggatcgagtgaaaaagacaaagcgtacgttttcagtctgtcaatggaggaataaatcgtatccatcagctgttccacgtatggattgatgctgtaataatctttttcggcatccaatctgcctgactcaatcaaagtgaacatgtgaagccagacggcaagcgccgaatgaatctgatataagcttttaagctcgggttttttcggggcgtgttttttgagcgctgacagatagccgtaataaaggccctgcatcgtctggcttccggccggcgtccgcgcctcccacagcgagaattccgaatcaaaaaaagcgagccagcttgacagcgactcttcattcggcagcactttttcctgaaactgccggcggacaagctccctgctttcctcaagcttttctctttccagccaatgttcggtaaaggtaccgacccgctcgaattgggcatatacgtaaagaaaaacggccagcacgtggcggcagatcgcctcagacgggcatgcgcagccgcttttcaccatgaaaaataagttcagcgtgacccttacaggcacaacatcctgcacatatgcggaaatctctgtcggggtttgaacctgtatacgatagacggaatcctgccgatataaaatgagtgctttcttcatcagctgaacattgtcttcattgtaaggaagaagttctttaagctgttcagccgctgcgagcacatcttctttagcaatcatatcctgaagcatgattatcgctcctaacgagtcacaaaataaaaagattccaattcctctattatatcgcaacacatggcccggaaaaagtttttcctaaaaaaggacataaaaacccgaatgtgtcgaatgatgtattagagattgcaaaacagcacccgacagcatataataatcttgttttcaatttaatggaagccgaaaggaaacgaatgatgaagaaaacgaagttagatcaagaggagtttctgaagattttaatgcatgcgcacgacattggtgagcagtcctctgagatgaccacaaaagaaatgcttgagaatttgatttcttatattaaaaatggatatgcaacataaaatcccgcaggctcttggccgcgggattttttaatcttcctgtgacaccagtatttaaagcgcttacaaaaataaaacagattgaagtgattgtctatttttgtcgaattttgtcatttgaaaaggttagaaatgacagtttaaaactgtataatcgtaattggaaaagatcattggagggaatgggaatacgcggaaagtgatatggaggttatatgggagaatctacaagcataaaggaaatattcgcaatactgagaaagcgtctgctgtttatacttattattaccgcggcggcatctgccgcaggcggactcatcagtttcttcgctcttacgccggtctatgaaaactcaactcaaattttggtcagccaatccaaaaacaatcaaaaagaagtccaattcaatgacgttcaaaccaacctccaattaatcaacacgtataatgtcatcatcaaaagtccggtcatcctcgatgaggtgattaaacagctgcatctgtccatgacttcgaaagagctggaatcgaaaatcacggtatccagcgagcaggattcacaagtcgtgacgattgccgtgagggatacggatgctaagcgggcggccgttatggcaaatgcggttgcagccgtttttcaggacaagatcatcgccatcatgaacgtggataatgtcagcatcctttcaaaggccgaagcggcggacagccagtcaccggcagagcctaaccgcaagctgaacatcgcgattgcgtttgccgccggacttttgggcggaatcggtctcgcctttttgctggaacatctggataatacgatcaaatcggaagaacagctggaatcgctgctcggcatcccgatcctgggaacggttacttcaatcagtactaaagacagcgttgccaaaaacttgaggatggcggaaaccaaacaagcggggggcggacatgttgacgcgtaaaaaagacaaacccggaaaacgaagcgtgattgcgatgtctgagccgaaatccatcaactcagaacaatatcgcacgatccgcacaaacattgaattttcttccgttgatacggaggtgaagtcccttttgatcacatccgccggtccggaagaaggaaaatcgacaaccgcggccaaccttgccgtcgtatttgcacagcaggggaaaaaagtgcttttaattgatgcggatctgcgcaaaccgacggttcatttcaccttcaaattggataacggaaccggattaacgtcactgctgttaaaacagatgccgtttcagaaagccgtcctgccggctgatgaagcaaacctggatattttaacgagcgggccgatcccgcccaatccggcggagcttttatcgacgggtgccatgaaagatcttctgtcagaagcagccgaagtttatgataaggtgattttggatacgcctcccgtcttggccgtagccgatacgaaaatattaggcagctacactgacggggccattatggtgatctcaagcgggaaaacggacaaggaaaaagcggccaaggcgaaagaagcgctcgattactgcccgtgcaagctccttggggccgtgatgaacgggaagaaacaaacgaaacactcggactacgcctattacggacaataatgtcataatgggcgcggtccattctttttaaggagggattgaaatatgatagatatccattgtcacatccttccttccatagacgacggcgcggcggatgatacagaaagcctgaagatggcgagagaagcggtcagacaggggattgatacgatcatcgcgacgccgcatcatgtgaaataccgctatgacacggaccggcatacggtcaacgaagcggtcagcctgttaaacaaacgtttgaacaaggaaggcattccgctgactgttctgcccggccaggaaatcagaacagacggagatctgctggcaggtcttcaaagcggctcgcttgtcccgctccataatacaaagtatgtgctggcggaatttccggcggatcatgtcccggcctacgctgaaaggctgttttatgaactgcagctgaacggatatgtccccgtcatcgcccatccggagcggaacagggaaattcgcgaaaacccttccgtcctatacagtcttgtgaagaaaggggcggtcgcccaagtgacggccggctgcattgccggagcattcgggcggaaagcgaaatccttttcgctgcagctgattgaagcgaatttgatccactttctcgcatctgacgcccataatctcggaccgagaaatttttattatcaggaggcgctcggcgttctgaaaaaagaagcaggggctgagctgatttacatgctcgcggaaaatgcggcgcttctcgctgaaaacaaagccgtttataaggaacctccgctgcctgtggcccgccgtaagcgctggggtcttttttaatcgtcgtctccatcccgtttaaatgaagcgtaagcggctgttttgcaagatgattcttttatgcttatgctattatctagcggccggcgccgttttttcctatcatgacctcaggcttccggcattcagccggcgccggaatcatatgataataacggtaagctgcccagcagcaatttctaaacggttgggggaacacgatgaaaataacagtgatcggaacaggctacgtcggtcttgtgacaggagtgtctctttcagaaatcggccatgacgtaacatgcatagatattgatgaacgtaaggttgagcagatgagaaagggattgtcccctatctttgaaccgggacttgaagatatgatgaaacgaaatatcggccggcatcggctggcatttgaaacgagctacgaaaaagggcttgcggaagcggacgttatttttatagcggtcgggacaccgcaaaaagaagacgggcacgcaaaccttacttatattgaaaatgtcgccgaacggattgccgaacatatttctaaagatgcgatcgtcgtgacaaaaagcacggttcccgtgggaacgaatgacaggatcagcgaagttattcattcacggctgaaagcggacgtgaacatttcaatcgcctcgaatccggaatttctccgtgaaggttcggcaattcacgatacctttcacggcgaccgcatcgtgatcggggctgaagaccggcagacgcgggaaacgcttgaccgggttttcgcgccgcttgcgattccggtatatcatacggacatcagaagcgctgagatgatcaaatatgcgtcaaacgcatttttagcggcgaaaatcagttttattaatgaaatttctcatatatgtgaaaaagtcggtgcggatgtggaatcagtcgcacacggaatgggattggataaacggatcggcaatcaattcttaagagccggcatcggttacggcggttcctgttttccgaaggatacaaacgccctcgtgcagatcgcgggacatgtggagcatgattttgaattgctgaagtccgtcattaaagtcaacaataaccagcagtccatgctggttgataaagtgctgaacaggctcggcggtgtgacggggaagaccatcgcgttattagggctgtcttttaagccgaatacagatgatatgcgggatgcgccgtccattgtcattgcagatcgtctggcggctcttgacgcccggatgacagcgtacgatccgatcgcttcattccgggcttccggactgcttccggctgcggtttcctatcgggagtccatagaagaagccgtcaggggagcggatgccgtcctgattctgacagattgggaacaaattaaacacttcccgcttgaagcgtacaaagagctgatggaaaccccggttattttcgacgggagaaactgccactcgcttgaggaagcggaacaggcgggcgtggaatatatctcaatcggaagaagagccgtcgtgcctcagactgattctgtcacttgaaaggccggcggaccgcgccggccttttatcatacaatctttagagacgaaggagatatttatcgtggaaaaaacatggaaattgccgaagcaaatggaatcatcccgcggtctgctggaaacgtcagcacggccttttatcaaactgcacgtcaaaaaagctgaaacgggacggtatgacagtaaaattgcaggagacccctattttccgaaacatgaaccatatcctaaagatgaaagcggcaggccgatgaagcttctcgctcaaatcaattttgcggatatgcccagacttcctgattttccggacaccggcattcttcagttttacatatcggtcagtgatgacgtatacggtctgaattttgacgacgggtgcgcgcaaactggtttctgcgtcaaatattttgaacatgtgacagcagaagaagcggagctcatggatgatttttctttcgttcaggttgaagaggagtacgatttaccgattcaatccgaagcgctgatcacccctgagctgtctgctgaatgggtgctcccgtctgattttcaattcaggcagtatgccgggatggatgcctttgactatttcgagcagtttgacgatgaggtgtatgacgaatatacggcgaacgcattcggccataaaatcggcggctatgcgtccttcacccaggaagatccgcggtcttattctcatcaaaaccatacgattctgcttttgcaaattgattcagatgatgacattgattcgatgtggggagatgtgggaatcgccaatttctttatcagaccggaagatttgaagagaaaagatttctcaaacgttttgtacaactgggactgcagttaacgacagtatgatgatcatgatacaaggcaaaggagacggttaatcactgtctccttttttttagggaatttatcatggatacatagaggagatcgatgaatggatatgccgtttatgtgagtcttttggcgttaatgatgagcatctcggctgttgaaaataagccatttaacctatttaagctgctttctgtctattttaaaatataatatatggaaatatagtatggaaaagtctgtgctttttgtacgactttttgcgtaagacgaggtgaaaacagatgagccattcaagcacattaagccatattaacagcacgatcagccataaactgggcgaggttgaacaccaaattgataaattaaaagaagcgaaaagagagatagaatctctgcaggaagagggcgtatctgaaatcagggacatcctcaggccgcacctggaccatcattggaccggcacttttgctgaagaatttgatgaccggcgcgatcaggcccatacagaagcatacagaatcgtcacagacaaatacgacggttatatttaccgaatcggcttaaagatgacacagcttgaaattgaaaaaggagggctccttgccgccagaagcattgcgagagaggcagagcacctgctgacgctgggagaagaagcccttgacacggtcggagaaaaaatacaatcaatcaaaagaagctggagttggttttaatggcagaaataaaactcaaatacggaaccgtcatgaagcagcttgaatccgtcagcagcgctttggaggctgtttcgatcgggaacgccggttcaaacggaaaaaacaagctcgactatacctccaagtaccaatcccgcgaggcaaagcttgtatcgatgatcagcgaatacaagcaggccgttcataagaatatcgcggacgttaaagacaacgtagattctttgaaagaacaggacgaggcgatcgccgtaaaataacgaaagaaaggacttgccgatgagcaaagtgtttgaatcacaatcgttaacggacgaagcagataagagaaagaaacaatacgaagcccttgaagagcagctgcgtgcgctcaaacaagcctttcaaggcgtggccgatctgggtgatgctttgaaagggaaaggcgcagacaatataaaagatttttttcagggacaagcggaaatcgccgacagctggctgacgcttgtctctgctcaaattgcgtttttaaatggcatttcaggtgacattaaagatcaagaactcagcgatacatatgtggagacttcatttttggagcatgagctgcccaacgcggatttgaaagcttcagagattgtctccgctcataaagcagaaatcgattcaattttgtcaggcatcagcgatattattcatctcgacacatatacgctggatgattacgctgataaaatgggcgatgcccagaaaaccagacgtgacacaatcacggcagtcgatacgcttgatgaatccctgactgctgaatatcaaaacttagaatctctggacaacgcagtgctcagcaaatattctgttctcatgcaggccaccagcaacgggaaaagcgcatcccctatgtactatgacaaaaaagccttccacagcaatgaaatctacaaaagcgtcacggcgacagaaaaacagggaacggactatattgacgcaaaagcccagcaggccgaagcaagacggcttcaggaaaaggctgaagaagaagccaataaaccatggtacgaaaaaacatgggacggcatctgcaactttaccggcgaagtcaccggctattatgattataaaagagcagccgaaggtgttgatccggtgaccggagaaaagctctccaccgcagaacgcgtcacagcaggagcgatggccgccgccggattcataccggtcgtcggctgggcgggccgcgctttcaaaggcggaaaagccatttacaaaaccggaaaaaccgtcattgccgcagaacatgctttagatgcctataaaaccggaaaatccttagacattctcaaaatgactgaaatgggcgcatacggccttgtcgcctcaaacggattcacagaagccgtcacaggccgggatatgttcggaaacaaagtgtccgaggagaagcggaagcaaggggcactggaagctgcgctgagtttggttggagccggtgcattggcgaagcatgtaaacaaaggcataccgcttgcaaaatcgccacaagcaacaaaagttgaaaaagggaaaaagattctagaccaagtaaaagaattcaaagtaccgacgaatgtaaaaattcgtgtccacaagactgtcacaccggatggcgctactttcccaatcattcatgctgatatgaaaacgactgctgtgaaagatcttggggttgtgaagatggtgggtagtggtagcgggaatagtaagaaacttttcggtcaaaatggaactcaaattgcaagtaagacaacatggcaaaatgggaagacagaaagaatagacattgaaaacccaaatccagggcaaagagaaggtcaaattcactatcacgagccaaataataaaaaatggtattttgatgtagaaacaaaaaagttttatgaccaaaaaacaggtgaagatgcacctagcaaaattcaaaaagtacttaaagacaagagtgttcagaaagctataaataagggattgaaatttttaggtgaggatcctgtattttagtataggagtgaagattatatatggaatatacaaataaaaatatgaaaagactaaaagaacgacttgaagatcggagtaatgcaaataaagttgacctatctaaattaaaggatattatttcacctaatatagttaaagtagacgattgctatattctagatctagagtatgagttaactgataatacaacgataaattggaatagaattttgaaaatgtacggggataaaacggggtatgaagcatcgtgtaatgagctccgcataaacgattatttagactgcagtgatttgtctgatgaagagatttcactttatgcgtttcaggtagtagacggttgggaacaacatttaaaagaaaaatttcctgagcataaatttgttgtaattataagtattgatgaaggttttgcgacacttagatttcataaatatagagaagaggaaagcggttggctaaaggccgacattgaagagtacggaaacgaagctatccttgtaaaagaaattaactttagtaataaaatttaactaaaaaagcaggcagttatactgtacctgcttttttagtttttaccttgtgaaagcaagaaacattacaaatgatcaagcttttaatggtaaaactaattcaaaactgttgatttatagagaaaaaaattaaagtttaagttttgtgaaaagtgaaataaaataattcaaaaatgtaaaggagagaatgtaatgtcgcaagaacagaagttaattatattgaacgaaatgtttaaaaaagaaggcgatccacccggcagttatggcattgaactgataaaaaacgaagattgggaaaatcctttagaagatattatgtgtactgaacttaaagaattacttaaacaattgaaccttatttttatgaaagaaatgaaaaatgaattttaataaaagatataatttgttgaaggagtcttcgctagatcgacacacaggacgattgagagcaaagactattttaagagaggaaaaccaatgaaatgaaaatacatcaaattcacgattttgatctaaatgatgaatcggactttattcaaacacaacaatccctaatacataaaatcaacctatcccccgtcatccatccagactccgtcaacacatgcgcaggcgtcgacctcgcttattgggagcaggacggggaaccgtatggcgtatgcagtatcatcgtgattgacgctgatacaaaagaagtgattgaaaaagtgcacagcatggggaaaatcagcgtgccgtatgtttccggttttcttgcgtttcgcgagctgccgctgatcattgaagcggccaaaaagctggaggcagagccggatgtatttttgtttgatggcaatgggtatctgcattacaatcatatgggcgttgccacccatgcggctttttttctgggtaagcctacaattgggattgcgaaaacctatctcaaaatcaaaggctgcgatttcgagatgcctgaaaatgaagtcggcgcctacaccgatattctcattgacggcgaggtatatggccgggcgctgcgaacacggcgggacgtgaagcctatcttcttgtcttgcggacataacattgatttagaaagcagctatcagatcacaatgaaaatgatcaatcgagaaagcaggctgccgatccctgtccgtctggctgaccttgaaacgcatgttttgcgaacgttttatcggaaaaatcacgtgtaacacttgcagtccgggaggctgcaaatgttttttattgatcaggccatctgggaggatgacaggaaccacatgtaagaagcatagacgaagaaacagttatctatatcgaacaacatatcgggactgaaacaaaaagcacctgtccaggtgcttttctttataaatgaggaaccacaagccctccatacaaaaacgccgcgataatcaggaaggccggatgcatcttgaattttgtcaaggcaaggagggaaatccccgcaatcactatcgcttgaacccagccgatcgctttgatgccgtctgcgccgatttgccaggtaagaatgagcatcatgacggcgatgacaggctggacggacagcgtcatacctttgatgacgggagattggcggaagcgctgaatgatgcgcaagaggacgatcaatgcgagcgccgacggtacgacggtggcaatcagcgcaatcaggaacccgggccacccgcctgcgctgtagccgacatacgccgcgattttggtggcgatcgggcccggcaatgcgttcgcaagtgcgagcatatttgagaattgatcgtttgagagccagctgtatctgttgacgacttcttcaaacatcagagggatcgacgccggtccgcctccatatccgagtacgtttgcgacaaaaaacgccataaatacataaatcatgatcatgaggccgacattcctttatcttttgaacgtttatttgtgattttgtcctttaatttaaaatgaaacgcgccgtacgctaagaaaatgataatgacaaagccgggattaatctgtaacgtttgcaggccgataaaagcgatgataaaaaataggatgcccgtgacccagccgaaacctttaagcgctttttggccaaactcgtacgccatgatgccgagcatgacggcgatcaccggggtgacggcgccaatcatgccggcaacaattgctgagtggcttaagacattgacagcggcaaacaagcccgccatagcaaggcatgtaggcagaatgtgggcgagggttgccaagattgcgcctaacgtgcctttcagcttgaagcccagatacgcagccatttttgtggcaatcggtccgggaagcgcattagcgatcgctaatatttctccgaattcatcatcatctatccatttgtatttattgacggcttcatggcggatgagcgggatcaccgacgggccgcccccgaatccgagaatgcccgttcggaccatcgccgccgtaatgtcccaatagggatgtttcatggctatgtcctccttacagcttcatgcccgttctgcttttataccgtttaatcagcatttggcagtcgacgctgacgacgcctttttgcgtatagagccgttttgtcaaaaactcttccatctcctgatcatttgcgaaaatgccgtgcatatgcagcttgctcggtccggtcatatgataaaggcttgtcacggccggttccttttcaagctttaatgcggtttcctccaaatactgcggctccacctccacattaaaaaacacggacacatggcggccgattttcgccgggttgatgacagcggtgaatttttcaatcacaccggcatccagtaaatgctgaatgcggtgctgaaccgccactcgcgacaggttaacccgctttcctacgtctgtataggaaatcctcccttcctcgtgcaaaatcgaaagaatctgtttatccgtttcatcaaggacaagattcggtatgctgtattcatgttccaatccgcttcaccttccttcatttggtagacattattgtatcatgaaacgttacggtatgaagggagaaattttttattgttttcgatacgtaataacttagaattatttcttatcgaaaagtaaatagtgtgtgagattttctttcaggaatgtggatggccgcgaagccgctttttatacttgagaaaatttgtaaaggggcttgccatgaatacttcaaccatcggaacgaaacaaatggtcgtcagtccgcattatctcgcttctcaggcgggggccggcattctggaaaagggcggaaacgcatttgacgcggcagtggcggtcagcgcctgtctggcagtcgtgtatccgcatatgacgggtcttggcggggattcattttggctcacttaccataaagaaacgggacgaatcaaagcttataacgggagcggccgttcagggaagcatgtgacgagagacttgtatcggggcagagaagcgatccctctgcgcgggacagaaagcgccattaccgttccgggaatggcggacagctgggatgccgtgctttcggcgtacgggcgtctttcgctcgctgaggtgctgaagccagctcttgattatgcggcaaacggatttccggtctctgccgaccagtgcgcccacacagaacgcaatctcgctcttttagcctcgatgccttacacctcggccatttttacgagaaacaaaaaagcgcccatgcccggtgaacggtttgtccaaaaggatctggcggccagcttggagcagcttgcccagaaaggcagaagcgctttttatgaaggagacctcgctcaacgcatcacatcctttctgcaaaacaacggcagccgtctgacacttgatgactttaaagcccaccgcggcgagtggacgaacccggtatcctccgattaccgcgggtgcaaaatctatcaggctccgccgaattcacagggttttacaggcttaatgacgctcaatatattggaaaactatgatttttctcagattgaacacggttcctttgactattatcatctgctgatcgaggcgctgaagaagagttttcagcaccggaatgaagtgctgactgatccggcattttctcatattccgctggatcggctgcttgataaacggtatgcaaagcagctcgcggaagaaatcggtaacgtggctgcgccggcggtaagccggccggtcggaagcgacacagcttatgccgccgtcgccgatgcggaaggaaatgccgtttcctttattcagagcctctatttcgagttcggatctgccgttacagcgggggagacgggcattctgctgcaaaaccgcgggtcatttttttcgctggacggatcccatgtcaatacacttgaaccctgcaagcggacgttccacaccctcatgccggcgatgacctgtaaagaaggaaagcctcacatcctgtacggaacccagggaggagaaggccagccgcaaactcagacagcgatgattacgcgcatcattgattacaaaatggacccccagcaggcgatcaatgagccgcgctgggtctggggacggacatggggagaggagtatgaagggctgagggttgaaagcagaatcagccctgaaacgagagaagccctaaggcagagcggccaccgcgtcgagaccgttggtgattttgacgggcttatgggccatgcggcagcgatcgtcattgatgaagaaggctttctccaaggcggggccgacccgcgcggcgacggagcggccgcaggagtatagagctacgctaactgatgaaaaaaataagcacgccaagcgcggcagaaagacccgcgtaaaacgaatcgtacacatattgcttttcctcccgccggtgccgccattccattatgccgctgcagcaaaatagtttcattgaaaaaagtcaccgctgcgatgcccgtaataagcagtgtgatttcgattaatcgatgtgtgccgtttatcggcttctgctttttaacaggctttggcaaattgagaactttgacggcaaatacttgaaacataaggctgagcaaaataaatacggctgaaaaaatcagtaactgaatgaaatccatcatctgcctcctaaaaatgtgtctctcgtttcatacgagtgatggccttgtaagtttcggcattctataagacattaggctgagttacatggtaaaagactcaaaaagaccccttacgaaaggggtctttttgactagtttcttctattataatggttcctgcttcaggtcgggcggacaagcgtatatgtcttcccgagtctggcgtattcattccccgcgagccttgccgcaggcttcagctcatctgtccgtatgtagcctttatcggcgtcatatacttggtcattcaaatgaaaacaaacgactctgccgatgatgaggtctgtcgtcgtttctccgctgtcattttggaacggaagatggcgttcgagtatacattcaaacctcacttttgcttcttttataccgggaacgctgatgcaagcgctgtctgtcacagaaaggtctgtcatgccaagttcactgacatcaggatcaagccttgccgccgttttgttaatgtcttcaataatggactcatcactgacgtgcactacgaattcccgatgagcgagtgcgtttctcgcggtgtctttctggcgaccgtccgcgcggctgactgagatggccagaagcggcggttctgcggagacaacgttatagaaactgaagggcgccgcgtttacggcgccgttgatggatgaccgcgtagtgacaaatgcgatcggccggggaacaactgtgcccgaaagcaatttgtaagtgtcttttgcgttcagttcgtctgctcgtaagatatgcatgatttcggccgcctttctttatcgtatgacctgattatacagaaagaaaattcggaaacacaacaaaagaaaaccggctgcatatcttatcacgtggcatatatctgattgaggaaaaaggcttccgtttagccggcagcctatttacgaatggtgttacttgtagtttttctttacaacccagatgttcccgtctttccagtactctgttttgctgcagtaatcgtcttttttgcaagggtcttttttctgaggacgataaggttttttctgcgtgcgttttttcttgcggcggcatgatttcttgtggctgcgagattttttgtgagaccggcatgattttttacggctgcgagattttttgtgagagcgggattttttatggctgcgagattttttgtgagaacgggattttttatggctgcgagattttttgtgagaacgggattttttatgactgcgagattttttgtgagaacgggattttttatggctgcgagattttttgtgagagcggcacgattttttatggctgcgagattttttgtgagagcggcacgattttttatggctgcgagattttttgtgagaacgggattttttatgcttgcgagattttctcttcttactgctttttggttcttggtacaaataatcttccaatccctcggtgcttgcggactttactgcttcttcgatatcagaatgggaatagtggcccattttgaaacctcctcatgatatatgttttaaggatgcgatccttactaccacatagtacgcatgaatgaaaaaagtgtatgtgtgattcgctgagttttatataaaaagcacagcctaaattaatacagggaggtttaccgatgaaagaccaatcaacattgcctctataccagctgtttattcacccgaaagacttaatggagctgaaaaaagacatttgggatgatgatccggtgcccgcggtgctgagagtgaatcaaaaacggcttgacattgatctggcgtaccgcggctctcatataagagattttaagaaaaaatcgtatcatatcgctttttattcgccgaaaacatttcgcagggcgaaagagatacatttaaacgctgaatacaaagatccgtcgatgatgcggaataagctgtctctcgatttcttcgcggagcttgggacgctgtcaccaaaggcgaatttcgtaaccctgcaaatcaatggcagacatgagggggtgtatcttgagctggagtcagtggatgaatattttctggcgaaacggaatttggcggacggggctgttttttacgcggttgatgacgacgccaatttctcccttgtcagtgatctggagcgggatacgaaaacatcgctcgaacttggttatgaaaagaaaacgggaacgaaagaagacgatttatacttgcaggatatgatctataaaattaataccgtgccgaagtcagagttcaagggggagatcgtcaaacacttggacgccgataagtatttgaggtggcttgcgggcatcgtgtttacctcaaactacgatggatttgtccataattacgctttgtaccggaatcatgaaacgggactttttgaagtcattccgtgggattacgatgcgacgtggggaagagacattcatggtgatcggatggaggccgattatgtcagaatacaagggtttaataccttgactgcaaggcttctggatgaaccgtatttccgcaaagcgtacaaacggcttttggaagagacgcttcagacccggtttaccattgaacatatgaagccgaaggtcatgtcactgtatgagcagatcaggccgcatgtcgcgaaggatccatataagaaagaagagattgattgctttgaccgggagcctgaagtgatttgcgaatacattaaggagcggtcagccttcatcagcagtgagttagagcggtggaatatctgatttggaaatgaagaaagattttttacaaataggctggtgaatcagttcccgaaaataatcgtgatacgtatatatgcattatgctttttacattatgagaaaaatgactaggaggacaatagatgaaacgcaatacgaagcggcagcggtctgatgacaactttttgcatgcaatggaaggaaaagtgattactgtctaccggggaggcccggagtccaagacagggagattagcagacattcaatcggattatatcgctcttcaggttgataataaaatcgtttattatcaatggaaacacgtgaaaagtgtgacggaaaatacgagtgaaaccgtatcgccggccgaagcggcagaatgtgaaaaagctgatgattttcaagacctgatcagccggatgaccaatcgcacggtgcaattgaatcagggaggtccggaatcgaaaagaggaaagcttcacgaaacaggggatgattttctcgtgctggaaacagaagatgacggaattgtatattttaacgccgaccatgtcaaaagcatcagcgcggaacaagaagagtacggccaagaggaggagcgcccggaatttgaaatggctgatgattttcacggcatatttaaacgcctgatccacaaatgggtatccatcaaccgcggaggtcctgaagccgttgaaggtatacttgtggataattccgacggccactacactcttgtgaaggataaagaagtgctgcggatctatccttttcatatcaagagcatcagcgaaggggcaaaaggagcagctaaaaaagaggagaataaagacgacgagaataaaggtgagaaagagagcgccgaagaagaaaagccgcatgaagaagaatcacgcgaagagcagcgtacttcctctaaaaagtcgaaaagatcatcaagatccgttcgatcctcaaaacgggaggaagagaactcttatagctacgccactgtattaaggacaatagattatcggtggaaacacggccgtaaatgattggaaagattgtccgtaaacgcgggagaggggggaatgaaatggctggattaagcagatttctggataaacaagtcgatattgagatatcggggaatacgacattttcaggaactcttttggatatcggtcaggatatcattgtgattcatgacggccggacgtttctttatattccgctgctgcatcttcagaggatgacattgacgctcccggacgaagagaataaagaaccgtacgcaagaaaaaaaagtccgcatcccgaaaaacaggaacattccttttcttaccggaataccctccagcatataaaaggcagattcacagaaatatttgttacgggagaccgttccattcatgggtatgtgacaagtgttttaaatgattattttgttttcttctctccggtttataagactcttttcatctcgatgcatcatttgaaatggctgacaccctattccgatgagcagacgccgtatacattaaacagttcagagctgccggttgttcccgctaatgtgccccttgtccggaattttgaggaacaattaaaaagatatatcgggaagctgattattctggatttaggagatataccgaataaagtggggctgttgcaggatgtctcagataatattcttgaattgaccaatgcagacggcgatactgttttttggaaattgaatcatttaaaaaccatgcacctgccataaatgataaaactgcctctcttatacagcaggcagttttttttcatgggagctaaaggtaaatccaactgatccaaacatataaaacggtaatggtaaacacgacagtgagagggacaacgataatggtcgttttgatatattctgaccaagaaactttttcgccgtgctgtctgatgatatgcatccagatcagcgtggctaatgtcccgatcggcagaagcaatgatccgatatcactgccgataatattagccagataaatgatttttacggttaatgggtcgatggacatttcagttaaggtcaaagtgctgatcattaaggcgggatggttattgaacaaattagagaggacggatgtagcaatgcccataatagatgcagcgtgggcaatgctttgtgagacataaggctcaatagactgaacaagcagcgccgtcagtccgatattatgcagtccgtagatgataatgtacatcgtgaaggcaaaaataaagatatgccaaggcgctttccttaataaatctgccggtccgatttttaaataaaaccatctccagccaagcaggatgactgaactgatgacagccacgagcgaaacggatatgccgttgtaagaagctgcaaacagactgatccggacgaacaatacaaatgccaaaacacaaaacatgatgttcgtacggctgttttgggtcgggtctggcggaggctgaagcggatgatatcgtttgtgttccagcgagtcaaaatgaaccggaatatcggggagctgtttcggcaaacggcggtaaaaaacggcaaacagcagaaaggccataaacaccagtcccagcgtgccggggataaacatcatattggtgtacaaataaaggtccatgcctatcattttgagagaaattaaattgacgatattactgacgccgatcggggtgcttgcggctgtcgcaattaatacgccgcttattaaatacggtgttttctgatgtcttttaagtccgagatattgtaagaccaatagtaaaataggagtggtgattaagacgctgccgtcattattcagaaagagcgtcattgaaaaacagagcaggttggtcagccaaaaaagccgaatgcccgatcccttggcgcggtgaagcagtttggccgccgcccagttaaaaaaaccgaagctttccagcgcgattgccataatcattgtggagataatggttattgatgctccggtgacttttgaccctatatcccccaaatcatgaaaggaaacggttccgcataacaaaacgagaatggcgcccagcgacgccggaacggcttcatttaatcccccgggtctccaaaatataaaaataatggtcacaaagaaagaaatcagggtcaaaatgacggtaatatgtgtaatgtgttctgcctccttttagatgggtcattgccgccccgttatttttatccctcctgatcagttgtactgtatgtatacgggtacaggtcgtaaggtgtactgagcgtttctaccaatttagtaaaaatccataaaagcacaaaaaaaagaggctgctttcggcggccctcttttttatgcattttccttatccgcctgcaataaagcctggcgtttattcataatatccagaaagtgtttcagaatcggattttgattatccttgcggtaggcaatgacccattcggccgtgagctgcacctgattaatgccgcggtaggcgacttcgagattaaacagctttttagcagaagaaggcacgaaggttacaccgatgccggcactaaccaatccgatcaccatttgatactccgtcgcttcctgaacgattttcggtttgaagcccgcctgctcgcagtagtttacaaactctaggtataaagtcggccatgtttctttcgacagtgtgataatcggttcattttttaaatcctgaatgtcgattgtctgtttagcggtaagcgggtgctgcttcggcaaggccagaatgcacggactgctctgcaccttttccatatgtaacgcggaatgctgtaaaggcggatgaaggatgccgatatcaatgttccccttcagaagttcttcctgctgtctgaaagaagaaatttcacgcagatcaagcttgacggaggggaatttttcgcggaattcccgaatgatcggcggcagaaattcatatgtggccgagccgacaaaaccgacgacaaggcggccgagctctccccgcgccgttctctgcgccatttcaatcgctttgtctatttcttcgatcgcgtttctgctgtgttttaaaaaactttctccggcagctgaaagctctacaacccgtttcgtgcgctttaataaggtcacgccgacttccttctcaagctgtttgatctgctggctgagaggcggctgtgtcatatttaaccgaagcgcagctttgccgaaatgaagttcttcggcaacggcaataaagtattgaagatggcgaagctccatccttatccattcctttctctttgttaattattcgtgaaacatattaatcatacggcgaattgatattggaggtcaatttccaaagagtgtatagtgaataatatcacaaattacttaaaattttatatttaatatgcataataaggagtgagggtgttggcaaaagcaacaaatgaactaaaaacctctggaaaaaatcggggggcggagcttgttgttgattgcttagtggagcaaggtgtcacacatgtttttggcattccgggtgcaaaaattgatgcagtatttgatgcgttaaaagataaaggacctgaactggttttatgccgtcacgaacagaacgctgcatttatggctgcggctgtcggaagactgactggaaaaccaggcgtttgtctcgttacttcaggcccgggggcatccaacttggcgaccggcttgttaacggctaatacagaaggtgatccggtagtggcgctggcgggtaacgtaattcgcgcagaccggttaaaacggacacaccaatcattggacaatgcggcgctatttcagccgattacaaaatacagtgtagaagtacaggaaacagggaatataccagaagcggtaacaaacgccttcagggcagcgtcagcaggtcaggcaggcgcggctttcgtgagctttccgcaggatgttgtgaatgaaatcacaaatgtgaaaaacgtacgcagcgtgccggcgccgaaacaaggccctgcaccggaagaagcggtcagcgcggctatcgcgaaaatccagacggcgaaacttcccgttctgttagtcggcatgaaaggcggaagaccggaggcggtaaaacaaatccgcaaactgcttgccaaaacaaaactgcctttcgtagaaacgtaccaaggggccggcacattgtccagagagctggaagaccaatatttcggccggatcggactgttccgcaaccagccgggcgatcttctgcttgaacaggcggatgtcgtattaacgatcggttatgatccgattgaatacgatccgaagttctggaacgtaaacggtgaccgtgctattatccatcttgacgaaatccaggccgatatcgatcatgcctatcagccggaattagaattattaggcgatatcgccgctacggttaaacaaattgaacacgacgctgtgacatttgatatgggcagccgtgaacaagaagtgctgagcgaattaaaacagatgctcacagacagcgagaaggcgccaagcgaccataaatccgacagagtgcatcctctgcaaatcgtccaagaactgcgcaatgcaattgatgacgacgtaaccgtcacttgcgatatcggttctcacgcgatctggatgtcccgctacttccgcgcttatgagcctctgaaactgttgatcagcaacggcatgcagacattgggtgtagcgcttccttgggcgattgccgccacattggtgaatccgggtgaaaaagtcgtatccgtttcaggagacggaggattcctgttctctgcaatggaattggaaacggcagtccgcttaaaagcgccgatcgttcaccttgtatggaatgacagcacatatgatatggtcgcattccagcaaatgaaaaaatataaccgtacatcatgcgtagatttcggaaacattgacatcgtaaaatatgcagaaagcttcggcgccaccggcttgcgcgttgagtcaccggaacagctggcagacgtgctgcaaaaaggcttgaacacagaaggtcctgtcatcattgacattcctgtcgattacagtgacaatgtccatttatcaagcgacatgcttccgaagcaattcaaagaaaaaatgaaagcaaaagctctctagcactctgcgcaccatgacctgttttctaaaacagcccaatttaaaaggagtgaagggaatatgaaaaacgcaagcgacatccatatgatgagccgcggagaaaaaggctcacctgaggatcagatctatcaagtatcaacaatgacatctctgctggacggagtatatgacggagattttgatatggctgacattccgaagttcggtgatttcggaatcggcacgttcaacaaattggacggcgaattaatcggatttgacggagaattttaccgtctgcgcggcgacggaacggctacgcctgttaaaggcggagacctgtcaccattctgctcattcacatttttcacgcctgatatgacgcatacgatcgacggcgaaatgacccgtgaagaattcgagcaggaaatcgccagccttctgcctagtaaaaacttattttatgcgatccgtttagacggcgtatttaaaaaggtgcagacaagaacggtagaacgccaggagaaaccgtacgttccgatgatcgaagcggtgaaaacacagcctgtgttcaactttgacgacattcagggtacaatcgccggcttctggacgccggggtacgcaaacggcatcgctgtttccggatatcacctgcacttcattgatgaaggacgcaattccggcggacacgtatttgactatgtcattaaagattgtaaagtgaccatttctcaaaaaatgaatatgaacctcaagcttccgaatacggcggactttttcaacgcaaatttagataatccgaattttgcgaaggatatcgaaacaaccgaaggaagcccggaataaattaaaaaagaaagccccatttttctcgggggctttctttttatttggctgaaccggcaaagattaggtaaaatacagtcaaaagggaaaggtgtggtagctgtgaaagtattggtattagcggttcatcctgacatgaacaactcagcggtcaataaggcgtggacagaagaattaaaaaatcatgatgaaatcacggtccgtgagctttataaagaatatccggacgggaaaatagatgcggaaaaggaacggcagctgtgtgaacagtatgaccggatcgtatttcaattcccgctgtactggtacagtgcgcctccgcttttaaaaacatggatggatcatgtgctggcgtatggctgggcttacggctccaaaggaaaggcgctgcacggcaaagaattgctgctggctgtttccgtaggtgccggagaggatgcatatcaggcaggcgggtctaaccatttttcactgagcgagctcttaaggccgtttcaggcaatggctaattttacgggtatgacctatttgccggctttcgcgatgtacggggttagcagcgccgatgctgcggctatccgtgacaatgccaaacgcctggcggattacataaagaagccattttagagtcgtatgcattcatcttcatccgacaatatttcctgagaaatatttcgaaccttagacgtttctgactgctcaagaaagaaaaaacggatttcgcgctgaatttgcgaaatccgttttgatattatgtcagtttttgcagatcttttgtgctgatatatcccgttgcgcccccgtaatcgacaagcgcccagccgaagtcaatgccgccgccggctgtctttttccatccgaggaaagaaacgctcgtgtttttagcaagggaagctttgaccgcttgtttgtctgtatatacttttgtttttgccgttgtttttacggttgttgcttctttaacaatataatgagtagatacaaatcctgtttttccgtttttataatgtacttttgcccagtcagcgttctggaatgaaacgatctttaagctgtcgcctaaatgaagggtatcagctctcggactggctgctgatgcttttgttctgacgttcaatgcttccgcggaaacgagataagagtcaagcgggtagctgtacagatcgtcaattttgaccgcttcttgcgcgtgtgtctcgggaagaggcgttattccggcagctgaagccgctgttattcccgctgcaagggtcagaatggatgccgctttggctgttttcttcatctgtatctctccttttacttcatcctttcacgttttaccggaagtctaaacatcggccggttatttttgtgtttgaagtttcaatggagcggaaatggtttttttgactttttctcctttgagcacctgctccgccgcttcggccgccagttttccgatcagctccggctgctgggcgaccgtggctgtcagctttccgtttttaatggaagaaatcgcatctttatttccgtcgaaaccgacgaccagaatgtgtttgcctgagctgttaatcgcttcgagcgcgccgagtgccatttcatcattatgggcgaacacggctttaatatccggatgtccctgcagcaggttttccatgacggtcaatccttttgtacggtcaaaatccgccgcttgctttgttacgacatccagctttttgtcggcaatatgatgaaagcccgttccgcgttcccgtgtcgcggatgcgcccggcaccccttgcaattccgccactttggcgccttttccgagctgatcggcgaggtagtcagccgccatttctcctcctttgacattgtcagaggcgacaagcgtttcgactttgccgtgttcggctgaacgatcaagcgcaatgacgggaatgccgagggaatttgccgattcgacggctgttgaaatcgctgatgaatcggtcgggttgatcagcagcgcatcgactccctgctggatcaaatcttctacgtcatttgactgtttagatgaatcattttgagcatcgacaataatgacctgcatgccccgttttttggcttcctttacaacgccttcttttaatgaaacgaagaacggattgttcaatgtggagacggagagcccgatagtgaattcttttttatgttttgtgtttgacggttttgcccattgtggcggttcaagtgaacaggcggacagcaaaaacagtgataatgccgcgatcgtgatgatggctttcttcataatggtcctcctactatgccgattttttgcggtccagcagcaccgcgattaaaatgacgattcctttgacgacgagctgataaaaagatgatacgccgagaaggttcaagccgttgttcagcgtaccgataatcaaaaccccgatcagcgtaccgatgatgcgccctcgaccgccggacaggctcgttccgccgagaacgaccgctgcgatggcgtccagctcatatgattccccggccgtcggctgtgcggaatttaagcgtgatgtcagaatcgctcccgccagcgccgataataaacctgtcagagaatagatcatgatcttgatgcggggcactttgattcccgatatcagcgccgctttctcattgccgccgatggcgtatgtccggcggccgaacggtgttttgtgcagaagaacccacagggccgcaaatgcaatcagcatcgtaatggcaggtacgggaatgccgagaaaataaccgcgcccgaataattgaaatgcgtaacttgaaccgagccccgtaatcggatttccgtccgtatagacgagggtcagtccgcgaaagacggtcattgtcgccaaagtggcgatgaacggcgccatttttccttttgtgattaataatccgtttatcatgccgagtacggcgccgattacgcagccgatgatgacggctaagatcggatcgatgcctgagaccatcatacctgcgaccaatgcgctcgataaggcgaggatcgctccgacagagagatcaatgcctcccgttaaaatgacaaacgtcattccgaatgcaatcagagcgttaatcgcaacctgccgaagaaggttgagaatattgaggggttcaagaaaactcgggtttaaaacggaaacgatcagcacaagaatcagtaagccgagaaacggaccgagtttttgtgtgaaggtgtgaatggaaaatcgcttttgttcagttgatgtcattggttcagttttcatactgctgccctcccgtggcaagtgtcatgatgtgttcttgtgttgcgccggccgcattgatttctccgctgatgcgcccttcgtggacgacgatgattctgtcactcatgccgagaacttccggcagctcggaagacaccatgatgatggcgactccgcgatcggtcagttcattcattaatgaatagatttcccttttcgcgcctacgtcgacgcctcttgtcggttcatcaaggatgagaactttcgggccgattccgatccatttggcgatgacgactttttgctgatttcctcctgataaatgccgggcggcggtttccggagatgcggtcttaatggtcagacgcttgatgagcagctcaacgaactccgcctcgcgttttcggtcaatgatgcctttcggagagaagctggtcaggttcggcaatgagatattttcacgaatggacgtatccagcagcagtccttcatctttgcggttctccgtaatcaggccgagtcccttgcggatggcatcgtacggaccccgaatgccggtttttcggccggaaatccagatctctccggaatcgagcctgtcaattccgaacagcgccctcatgatttctgtccgtccggcacccattaagccggaaacgccgaggatttctccggcgctcacatggaaactgatctgtgaaaagcttcctttttttgaggcgtttttcacttcgagcaccttatcgccgagtgacggcgtgcgagtcggataccgatcggtcagctcccgcccgaccatttttttgaccacttcatcaaaattagtttctttcatatgcgccgtatcgacagtgaggccgtcccgcataatggtgatccggtcgcaaatcgaaaatatctcttccattcggtgcgaaatatagacgatggatacgccgtcccgctttaacgccgtcatcacgtcaaacagtttgctgatttcccgttcggtcagcgccgcggtcggttcgtccataataatgacttcggcgtttgtcatcagcgctttggcaatctcaatcatctgctgctgtccgacggaacattgtccggcttcccggtcaagaggaagagagactcccagtttttcaagctgtgattttgctagcgctttcattttcttcgtttccaaaacgccgaacgccgtcgtcagctctttgccgataaaaaggttttcaagcaccgtcatgtccggccatatattcagttcctgatggataaaggcgattccgtgcttttcggcttcctttggattggagaagctcatatttgttccgtttatcgtaatgtttcccttgtcgagccggtagagcccggtgagcagattcattaacgtcgatttgcccgctccgttttctcccattaaagcgtggatttctcccggcagaagctcaaatgagacgccggaaagcacttggtttttgccgaatgctttatgaatgtctgtcatgccgatgtgcatgctggatcccttctttctagaaaatcacacccgcctgcaggatgcagttggcgtatggtgtcatttcacccgttcggatgacggcttttgctttctgtgtgagccgtttgaattcctcgtgggacatgtactcgatcgtctgcgctgagaaatggctttctatgaaacttgcattctcggggtttgcgtctttgatctcggaagcggcgatcaccttttcgactgccatctccccggctaccaggctggtcacgtcccgaaaggcgggaacgcccgccattaaggacaaatcaattttagggacaccgtcagggacggggagacccgcatctgcgattgcgatgaggtctgtatgccccagatcggccaatactttggcaatgtggctgtttaacattccgtgttttttcatgacagcagctcctcaacttcttttctggccggcatgccgccttgggcgccgaagtgctgcacggacagggaggcggcgcggttggcaaacaggagcgcttgctcaatgtcccgtccttccgcgagtgcgacggcaagtgccgcattaaaggtatcgccggctcccgtcgtgtcgaccgcttctgcagggaaggcgggaacaagccgttccgcggtgccgtctgagtagcgcacgccttgttttccttcggtaatgaacagtttgccgggatagccggcgagcgcttcttctttcgtccggtcaggaaataaaatggacgcttcatgttcgttcggcgtaagatatgcggcatcctcaatcgtcgattgtttcagcggccgggccggcgcgggattcaggataaccggaatttgctgcgcgcggcagtagctgcacacttcttcaacggtttcttcaggaatctcctgctggatcagcacgatatcaatgccgggaagttttgccagcgcacttttggcataatcgggggagatgtcatcgtttgcgccttttacgacgacgatgctgttgtctccttctgcgagcacaatatgagccgttccgctttttttatgtgtaaccgtttccatgtagtccgtattgacaccgtttgccttcaggttttcaataatcgcttttccgtagctgtcacttccagcttttcctaccatatatacgtttgcgccaaggcgggaagcggctacggcctggtttgcgccttttcctccgggcacggtttgaaagtctgtgcccagtacggtttctccggctttcggacgccgttcggatgtgacgaccagatccatagaacagcttccgataacacaaatttcactcatggtgatcatcctttctcgtcgtttgtcttcgtatgtaagtcacgggcagttgaatggccgtctctttcggcggctctttctttatcaattgcagcagcaggtttgccgcttgttttcccatctcatatgcaggctggcggatggttgaaagaggcggaaacaaaagcctgctctgcggaatatcgtcgtatccgatgatctgaatctcctccggaacttttttgccgagccgcagcgcctcatggaggacggcagccgccgcaatatcgttgctggcaatgactccgtcggtttccgggtatactgcaaacaattcttctgctaaaacggcagcatccttgatggaaaatgaagcggcggagatgacattgaactgaacgcccgctttttgcagcacgttaagtgcgccgttaaaacgttcctgagcggtcggaaggtgggctgggcctttgacaagcgtgatgcttgtgcttttgccgcgaagcatttcctcagccgcccgttttccgcctgcccgcccgtcactgaatacggatggggcgccttcttttgtccggtccagaaatacgaccgggtaaaggctgccgctgtattcgggaaggtcggggtaatgggtggccgccaaaataccggcaacttgattttgtttaaatgtttgcaggtagtcgagttctttttccaattcttcatcgctgttgccgatgatcagccggtatccttcccgctgcaactcgtcttcagcgccgcgggcaagctgagggaaaaagggattcgtaatatccggaagcaagagcccgaccagtctggattctcttttataaagagagcgggcaacttcattcggataataattcagcttctccatggcaagcatgaccttcgttcgtgtatcttcatgcacgtagccgttgtcattgaggacacgtgaaaccgtggcaacagagacgccggcagcgcctgcgacatctttaatcgttgccaacaaacactcctccttcaactgtgtaaccgtttacataaaaagagtaacacgaatcatttcggttggcaacaaaaaaagagaccggggtctcttttagttcacgatgccgatttgtgagatattcactttgatatcagggatgatctcgatggaaggatagacctcacgccaattgagccgcttgccccgctcataataatgggtttgatatttccggccgatgccgaggatatccgagttgtgctcctgaatatggctgatcaccgatctggcctggctgttcaaatttgctgaggcttgtttgttcatttggtcgattgccgtataagaattcagcttgtcctttggatattccaagacgcgtgcattcagttttaaacggattttcacttttatatgctgcggatctgtatctataaatacaatctttcgcgtggcatccgtgatgccgagagaaagataattttcaatatccattttgtatttgtcccacagcttcagattaatattagccgatttattaaattgcccgcttaaaagggtcaggagggttgaatcctgaccgagcacctcagtcactttccgctggccgctgaacagggcagaaccctctatctttatcgtctgtccgttaatcgataaataaggtagggcgaaatccttatcagccgtcagcatgcttgaacggatggattgcaaattctccatgctgatatttgattccgcattagcgcttgttaataaattcgttaaatacttgctgacgatcaatttctgccggacgatcagcttcagcacttcaatcgcctcgccgtcttttacaaccgccggatgagcgagaagcgggcttttcggatctctgtaaaagacatcgagataaggaaaaagcggtttttccgccattttctcaccgattaataagactctttgcttggacgtgtcaatgcgctggtcgacaagcttatccaattgaaaccgcgcttcacggatggtgtgcccggaagcgctgagcaccgtcgtaatgaatgagccgcccgtttcctgttccgcctgggaggactgaaccttccgataggtgatgccgattttatttttaccgtcatgatcaacatcaaggcttgcggtcagcacgagagaaatatctttcagcaaattttgatcccagcagcccgcaagtgtcaggcttgcgcacatgagactgataagaaccgcttttttaatgcgcatggcggacaccctttttgcgtacaaggataatcaataccataaacaaaggaaacaaatacacaaacacaatatcggaaatgcggaaaaactgatccagctgctgtatcgttttatctgtgcttgtggcccaaatagacagaaggaagacgagcagggccagcggataaacaaaccggctgtgatctttttgattgaacagcttggcaatgccggtgcttgccaagtaaaacacgttggccagcgttgaaaagacggtcacgaaccaaaacgtcaaaaagagcagatccgtccgttcgataattctgaatgaaacggtttttaacaggtacagcacaggctccgggatcatttttatttcttcggggctgattgtgacaaagcaagtaagggtgatatacaggtaataaaggataatcaagatgtttgaaatcgtcagtattttgtagcgctggctgacggtgcagttgattaggggcccgatcacgagcgccgcctgaaagccggtaatgctgacaagtgtttgctgcaccccggtaagcatgtcttttgcggttccgtgaaaaatcggcataatgtatgtgatatcggcttttcccagcgtgtataaaagcggcagagagatcagcagcaaaaacggcgttaaaataaagctgaacctggcgatcgcattcagcggagcctgggcgatatagacagaaccgaggatcagcattaagctgatcacccaattcggagtctgagggagcacccagatatccaatatccgtgtaaatacagaaagaatgagcgtgcagagaaacgcgaaatataaaatatacagcacctgcacccctttgccggcaagtgttccgaacacctcctccagcatttcgtacaggttcagcttcggaaaccggtgaaataatatcatatacaggctgaatgtaagctggacgagcaatccggtaagcagaatggaaatccatccgctgcttcccgatttcatcatcagtaaatggggcagcgccaaaatgccgatgctgatctgcgtctgattaatgaaaaacacgccttgaagccggctgatttttttaggcttcatcttttctccacccccgaacatgtttcatctgctttgagtcttgcggtctcaaataaaaaggccttcttttaataaaccaagccggcagccggataaatgcatccttcaagtcactgaaatgaaacggcgtcaacgatgataaataaggaacgccgagtgattcaagcttgcacaggttcatcagaataagcccgaagccgagtgcgatgccgataaaaccgaacgaggatgccagaaacataagcggaaatctgagcgttcggatggacgtgctcatttcatatgaaggaagcacaaaagaagaaacagccgtaacggctacgacgataatcatcatattagaaatgagtcccgcctgaacgactgcgtcaccgatcacgagaccgccgacaatgccgatcgtctgactgatcggtctcggcagcctgataccggcttcgcggatcagttcaatcgtaatttccataatcatggcttctatcagcgggggaaagggaatatcaacaatcgaatttttcatggtgataatcagatcgttgggaatgacttcaaaatgaaacgcaatcagcgcgatataaaaagcgggcagcgtaatcgcgatcataaaggcgaaaaatctcagcactcttaaaaaactggcggaaatccatctcgtgctgtagtcgtccggagattgaaaaaaggaaaagaatgtgatcggcgcaatcaaagccgacggactcccgtccatcatgatcagtacacagccttccatcacgcatgcttttgctttatccggccgttccgtatgaatgatctgcggaaaaatggaaaacgaattatcttctattgattcctcgataatcccgggcgcaagcacgctgtctatacgcaagtatgacaggcgccgcttcacttcctccacaatctccggattggcgatattctcaacaaagataaccgcaacttttgatttggctctttccccgatatccatataatgaacggagagatggcggtcctgtatgtgaaaccgcagctgatgaatgttcgtttccaaactttccacaaacccgtcatgggcgccgcggacgatactttcagattcgggttccataatggaacgcagcggattctggccgacggaaaacagcttcgctttcctcgatgcatcgctgagaaaaacaacctgtcctgccaaaatcccgtcaatgagttttctgatttcatccgtttccgcactgctgacggcattcatcgtttcctcaagcgggccgttctgcagggtgtcgcttaacagaaactcattcagcttctgttcttctatcatctgttcaatataaaagaaagcggtatgacggtcctgcagtttgatccttcgtattttaaaatcaccgcaaacacacatcagctcctgcatttcccgtacagccgattcaaaatcgccgggaatccgtttgttttgtttatccgcagacatcagaccgcctcctttcctggttatctgtagttttcagcgggtattccttttttatgcattttataaaatagaggagttcctcgatgttttaccaagaacttcacaattatggatgaatatttcttgaacgaatataaagatttattaaaattatttcaaaagagtgataaacgtcctgtaaatggtttaaaaggagaaaggctttccgcatataaaatgtgtatttcttgtaaacactccggacccgtctttttctgtcatgtatcagtcattccgctagttattttggaatgggactgaaagcaggatacgggggaaaaatgaatgactttaagaccttatccttaacaaaacaggcagtctgcacacagcggacagagagtcccaaaacgtatgcgcagtgcgaaaaccgctgatacaaacgggctggaaaagatggattatcattacatctttttcttccggaacgcgaatagttccattggtccaaatgaatttctgcgcgaaaatgtaaacgcattcatttttcttttgaaaaattgaagtaaggttgaagtcctgcctattcccaaaaaaagcaattcgataataggaagaatagcgtcactaatagagaagtttggctcagtgaaagcgggaagattatgttacataatgccgattgagaattcatagtgaagctatatactgatgaatgaatttatcaatacagaaggagatgtcaaaaatcaatgtggttactcattatagcctgtgctgccgtactaatcatcggaatcattgaaaaaaggcggcatcagaagaatatcgatgctctgccagtacgcgtcaatattaatggtatccgcggaaagtcaaccgtaacgaggctgacgaccggaatactgatggaggcgggctacaaaacagtcggaaaaacgacgggaacagatgcaaggatgatctattgggatacacctgaggagaaaccgatcaaacggaaaccgcagggcccgaatatcggcgagcaaaaagaagtaatgaaggaaaccgtagaacggggcgccaatgccattgtcagtgaatgtatggcggtaaacccggattatcagattatctttcaggaagaactccttcaagccaacatcggcgtcatcgtgaatgtgcttgaagaccatatggacgtcatggggccgacgcttgatgaaatcgctgaagcatttaccgcgacgataccgtataacggtcaccttgtcattacagacagtgaatacacagacttctttaaagaaaaagccgcagagcggaataccgaggtcattattgcggataactctaaaattacagatgaataccttcgaaaatttgaatatatggtctttcctgataacgcttcccttgcgctcggcgttgcccaggctcttgggatagatgaagaaacggcgtttaaaggaatgctgaatgcgccgcctgatcctggcgccatgagaatcctgccgctgctcagcacgaaggagcccggtcatttcgtaaacggctttgccgcaaatgatgcatcttctactttaaatatatggaaacgtgtaaaggaaatcggctacccgacagatgaaccgatcgttatcatgaactgccgcgccgaccgtgtggacagaacgattcagttcgcaaacgacgtgcttccgtacattaaaacgaaggaactcatactcatcggcgagacgacagaaccgatcgtcagagcttatgaagaaggcaagattcctgccgatacattgcacgacctggaatataaatcaacagacgaaatcatggacgtgctgaaaacaagaatgcaaaaccgtgtcatatatggcgtcggcaatatccacggttcagcggaaccattaattgaaaaaattcaagagtataaggtgaaacagctcgttagctaggaggaaaaggataaatgttcggatcagatttatatatctcacttattttaggcgtgttaatcagtttaattttcgcggaaaaaacaggtatcgtacctgccggtttagtcgtgccgggttatttagggctcgtttttaaccagccggtctttattttactcgtattgttagtgagtcttcttacatacgtgatcgtcaaatacggtttatccagatttatgattttgtacggacgcagaaaattcgcagctatgctgataacgggaatctgcttaaaaatcgctcttgatttcctttacccgatcgtaccgtttgagatatcagaattccgaggaatcggtatcatcgtaccgggtctgatcgccaataccattcagaaacagggattaacgattacatttgccagcacgctgttcttaagcggcgcaacttttgccattatgtttgcttactacttaatctaatgtaaggtgtgtcaaacgatgaaaaaacaattaagctttcaagaaaaactgctgaagctgaccaaacagcagaaaaagaagaccaatcttcacgtttttatcgcgctgccgatcgtcttttgcctgatgttcgtctgcatcctgacagggaaggcggaaacgccgagtgtgaaaagaaatgccgatgaccttgtatcagcctcattcgtcggagatattatgatgggccggaatgtcgagaaagtgacaaagcataaaggcacggagagtgtcttccgttacgcaaagccattcttcgaagcatccgactatgtgtcggggaactttgaaaacccggttacatataaaaagaactacaaagaagcagaaaaaaatatccaccttcagtcaaacaaagatgccgtaaaagtattgaaggacatgaatttcaccgttctcacggcagccaacaaccatgcgatggattacggccctcaaggaatgcgggatacggttgaagagttttcaaagcaaaatcttgaacttgtcggcgcgggcctcacgctgaaggaagccgagcagaacatttcttatcaagatgtaaacggaatcaaaatcgcaacactgggtttcactgatgtttccggaaaaggctttgcagctaaacgaaatgcgccgggtgtgcttccggccgatccagagctgtttattccgatgatttctaaagccaaaaagaaagccgatcttgtcattgttcaaacacactggggacaggaatacgataatgatccgaatgacagacagcgccaattggcaagagcaatgtcagatgccggagcggatattatcgtcggacaccatccgcacgtgctagaaccgatcgaaatgtaccacggcactgttattttctacagcctgggcaacttcgtattcgaccaggggtggacaagaacgagagacacggcgcttgttcaatatcatctgcagaaaaacggcacgggacgctttgaagtcacgccgatgaatattcatgaagcaacacctgcaccggttaaaaaaggcagcatcaatcataaaacgatcgtacgtgaactgacgaaagaatcgaatttcgattggagcgtcaaggatggaaaattaacgtttgatgtggatcacagcgatatcttaaaaaagaaagcggagtgaaaaacaaatgaaaatcattaaagcgggatggccgtttgccgcgatcattatggtatttatgtttatgtcagcgtttaaatacaatgatcagctcacagatcaggaaaaacaaaaaattgacacggaaatgcaaaagattcagcaagaggacacagcgggcgcaaaataagcgcatgattccgcttgccggcatattgtttgttccgattccagtaaagaatgcccatatcgggcattctttttttgtgtgctctcctaaacatttgttaaaagttaccgatgtaaaaactactaaaaatgaggagagtgaatagaaaacatgctcacaagctggaggaagtacatccttgccggccttatgatttgtcttgtggcacccgcagtaacgagaacggaaattgctgaagcggattctcaagtttctgtcctgatggtttcagacgcgcaaaaacttgtcggaaataaatatgtttacggaggcgaagagcctgaggacggttttgatccgtccggattgattcattatcttttcagcagacagaacatccatctgccgagaacggtcagtgatcaatggaaggttggaaccgccgtcaaagaaaatgaccttttaccgggagatcttgtgtttttcaaaaagtcagattcaacacaaaacgcacccgtccatgacggtctttatatcggaaacggagagatgatacacagttctccgtcagaaggcgtaaccgtcacacggtttcaaaaaagcagttattggatgaatttatatcttggcgcaaagcggattacaaaagatccggaactggctgatgacccgatcgttcaggaggcagcccgttacctcgacattccgtatgtattcggcggaagcacgcctgaggagggattcgactgttcggggctggtccaatatgtttttgaaaacaagcttcacatttacctgcctagatcagcggaacagcagtggctggtcggtgagaaaattaaactgagcggcataaagcccggggacgtgatttatttcagcgacacgtataaaaaaggaatttcccatgcgggcatttatgcgggagagggaaggttcatccaagcaagccgctccgaaaaagtcaccatttcttacttgtcggaagattactggaaaaaacattttacaggtgtgcgccgattcagcaatttagccatttctaaagaaaatcccgttgtgtccacagcggccgatcatatcggaatttcttatctgaaaggcggcgtttcaccggaaaccggctttgatacggcgggatttgttcaatacatctatcaaaaagcgaaaggaatcagcctgccgcgttatgcggacaagcagatgcaggcgggcgttccggtcgataaacaagatctgaagcccggcgatctggtcttctttaaagcggaaagcctgaatccggccatttatatcgggagcggacaagtgattcatgtcaccgtgtccgcaggcgttaccataacaaatatgaacacaagcgcttattggaaggacaaatatgcgggcggcatccggcttccgtaaaaatagacgtcagagagtgtctctgacgtctttttcttttaccgtttcggcgctctgtatccggctgctaccgcatcctctacggaacagaacatttccgcgggatctgtcgtccggtcgtagtatgtacttcccggcgtgtgataaatgccgttccggctgcctttaatgtcgcatccctgtgaggtgtcggctgctttcgtttcggcatgtccgccggaggaaggggcgttgttttgcgccgtttccgcgttttcggatgtttttgtttctgctttctgccgctttaaagttttattttctgactgaagcgtttccgcggtcttttcgagcttcttttgtgaattttttaatttctcattgtcttgtttgagtgatttgtttgtttttttcagctcacttatctcttggctgagtttgctgagtttttcttcattgccggcttcggcttcggatttctccttttcggccgcggcactgatgctttcatattttttctcaagcgcctggtgttccttcgtcaatttttgataagcggtatcaagggtgctgtatttctcctctgccttcacggccgaggcgtccggctctgcgagggaggcgccggtcagaagcaggataaatccgccgatgagaaggggccaaaacagcttttttgaaaaacgtttttcttttttggcagctttgcatatgaggtggaatattccgtatccgactgcgcagagaaaagctaaacatcctataatagcgattgcattcgacatcatgaaactccttttttctttatcttacaatttattttcatttttgggaatttcttttttggaaaacgtgaaaagccaggccgtgaaagacctggctttttccttttattgatcgttgtcgagaagccggttgatgaaatatgcgacgccgttttcatcgttgctttttgtaatatacgtgcttttttccttcagttcatcaatcgcattgcccatggcgatgcggtttcccgccgcttcaaacatggagaaatcattcgggctgtcgccgatggcgtaaatatcttgtttttcaattccgtacagtgaggcaagctccgtcagagcacgtccctttccggaaccggcagggaggatttcgataatgtgttttccggaagatgtctgggataatttcggatgatgtgtaatttcttctttggcgtttctcagtttttccatatcaaaagagaaacaaagaagcttgtaaacatgttcgtctccgttaaaaatcgcctgtatatcctgtacgggtttaatgccgaattgtttgaactgcgtctttgcgccctcccataatgtctgaatatcttccttgggattggcgcttttcagaatatccagttctgcctgcagtttggactcgccgtcaaatggggacagcagatgatcatctgtatagacctcaaagtaaatgtctttgtccgttaaataagcggctatatccttcccggcctgctgatccattaagagccggctgacgaggcggtatcctttgtcatggactgtcccgccgtttgccgcaatgataggaatatctaaatccttcaagagcgcttttacatcaaacgtggctctgcccgtgcagatggccacgagaatgcccgcttcatccgctctttgtaaagccgctctgttttccggagaaatcacactgtccgagttcagtaatgtgccgtctaagtcaatggctatcaatttcatatgtatggatgccctccttaaaaataaagctgcttcatgtagtatgttcagctttgtgcgaaatcagcagaaagccttcagttaaaaggctataccttcatgtcctttttttcaacagaaaaacggcgggatttgctaatcccgccgtgacgtcttacgcgtttaaatcattttttaatttcgttttcacttcttgaaggttttcctcattcagcttgaagtaataaatatttttgccgtactgaggagtgtaaatatagctgtctgaacctgtcagctgcaaagaatccaccgatttcagcgatgtgataaacgggaacagaccgatggcgtcattaagagataagttcatttttaagtttttccctaagctgtcgacgatatcgtcataagatgggatcgagcttaacgatttagattttttaataatggcgctcagcacttccatctgtctttgtccgcgcatcagatcggtgtccgctttgcgtgttcttacataagccagtgcctgctcaccgtcaagcgtctggacgcccggcttcagcacgacttttccttttgtatcgactttaatacgatcggcaactttctggcttttcacatttaccgtaacgccgttcaactcattgacgacatcgcggaacgcgtcgaagttgctctcaaccacataatctaccggaatatcaagcatgttttctactgttttataagttaaattataaccgccgtaagcatgtgcgtgcgcgaatttgtcatagccgtgtcccgggatgttgacataggaatcccgcggaatgctgagcatcgtcgctgttttctttttccggttgaaggtgacgagcacgttggcgtcacttcttgcgtcatctactgattcgcccttattgtcacgggcgtctattcctaaaagcaatacggtgaaagaatccttcttcgggtcaaattctttgatccgttttacggactggtcgccgcggtcaaggctgacgtgcgcttctttggtcgcattattcaatttcacaaatgcgtaggtgccgacggaaccggcgatcaccaataagaaagcggcgaataccagtacaaatttcacccattttctgaggcgtcttttcttttttctgcgttgagatcgttcttccatatcattacctctcgtttctattctttgtgaagcgtaccataattgttgacttggagcaactctgcaaatgagaaaattccaaatctttctctctatttcgacaacatctactgttatttttgcatcaggttcacattatattggacggcaggaagcgggaaatgtttcgtcgctttgtaaaaaataattagtaaaataatggatattaacggtgcggaaggtttgaaacggacgaaaacaggtaaaagaagcagtagaacaattccgcgcggatacagcgttggatgaagggagtctacataacatgaaaagcatacactcgaataaatggctctattttttcggcgcactcggcggcgcgttatacggatatgataccggagtcatttccggagctattttatttatgaaaaaagaactgggactgaacgcctttacagaaggcctcgtcgtcagttcgttattggcgggggcgattctcggatcggggtttgccggcaaactgaccgaccggttcggcaggcggaaggccatcatgggagcggcgctgctgttttgtataggcggtttaggagtcgcttttgccccgaatacagaggtgatggttcttttccggatcattctcggactggctgtcggaacatctacaacgatcgttccgctctatttatcggagctggctccgaagcataaacgaggggcgctttcttcgctgaatcagctgatgattacggtcggaatcctcgtttcttatatcgtgaactatatatttgccgatgcaggcgcttggcgctggatgcttggacttgcggttgtgccgtcagtcattctgctgatcggaatcctatttatgccggaaagcccgcgctggctgtttacgatcggcaaagaagagaaagcaagagaaatcctttcatcattgcggggaacgaagaatattgatgatgagattgagcagatgaaagaagcggaaaaggaaaacgaaggcggcttgaaagaattgtttgagccgtgggtgagacccgcgctgattgccggcctcggacttgcctttttgcagcaattcatcgggacaaatacaattatttattacgccccgaaaacatttaccagtgtcgggttcggcaattccgcgtctatattgggaacggtcggaatcggcgccgtcaatgtcatcatgacgcttgcggctattaaagtcattgataagatcggccggaagccgctgctgctggccggtaatgcgggcatggtcatcagtctgctcgtattggccgcggtcaatcttttctttgaacattcagcagccgcatcatggacaacggtgatttgtttaggcctgtttatcattgtgtttgcggtcagctgggggcctgccgtgtgggtcatgcttcctgaattattcccgctgcatgtccggggtatcgggacgggtgtctccactttaatgctgcatgccggaacattgattgtctcattaacctatccgatgttaatggaagcagtcggcatcagctatttatttctcatttatgccgcgatcgggatactggcattcctgttcgtccggtttaaagtgaccgagacgaaggggaaaagccttgaagaaattgagcaggatctgaaaagccgtaacggaggctcgggatcagaatcaaatcggcggacagttcatccgtaatattcagttttagggggcggttattcaccggcccctcaaaacggatgccgtgcgggcgcccggtcacataaatgacggggatatgtcatacgttgtataaagtcacgataaaggcggggatgccggtgaaaacgagtattattatccttacatataatgaacttgagctgacgaaaaaatgtctggccagcattgaacgatacaccgacaaagataagattgaactgattatagttgacaacggttcctcagacggaacgagagaatacatatcaaatctgcctgacgtcaaagtcatcctaaatgaaaaaaacctcgggttcgccaaggggtgcaaccagggtatcgaagcggcagggggagaaaatctgctgtttctgaacaacgatacgatggtcacgaaaaattggctcacctccatgctgagggtgctgtatcaatctgaaaaaaccggtatggtcgggcccgtcagcaactatgtcagcggtgcgcaaatgatccataacgcatatcaatcgcttgatgagctggagtcattcgcggaggcgtattgcgcacgggaaaagcatcatacaaagcgggtgctgcgccttgtcggtttctgtcttctggtgaaaaaaagcgtcattgaagacatcggcccgttcgatgagcaattcggatacggttcttttgaagatgatgacctatgtctgcgcgccctccaaaaaggctacagcctgcacatcgccctcgatgcctttgtgcatcaccacgggcacgcgacgtttacggctaatcaggatatcaatatcaatcagttatattcggagaaccgccagcgttttacggaaaaatggggcactgattttacgtactttactcatccgagaccggaaattgcggagctcgttccccgggaggcgaaacggatacttgatgtcggctgcggcgcgggggctacggggctggaacttcaaaacagacagccttgcgaactgtacggaatagaactgcacccgctggcggcgcaagcggcaaaaggacactatgaagcggtgctgcaggaagatgtcgaagaagtgaagctgccttatccggaaggcttttttgattgcatcattttcgcggacatccttgagcacttaaaagacccgtggcgcgtcattgaaacgtactcatcctatttgtcgcctgccggatcaatcgtttgcagcattccgaatatttcccacgccgaagcgctgtttccgcttctgctcggtgactggacatacagagacgccggcattctcgaccgcacccacttacggttttttacgccgcagacggtgcgcacgctctttccggaagagacatttgctgtgaaaaagcagtcctatacgtatgttcacgtggatgagcgggtgcagctgtttttacaggaaatcacacgaatggcgcaatcgatgcaatttccggtgatacagctgcccgaacaaagccggatttatcagattctcctccgggtcgaaaaaacaggctgaaggctaccgtcccatcgttccgaagttggtaatctgaatggaaacatcatagtcaaaggccgcttcggagaaggtctcatcccaatgatgctttactttcttccaatagtcgggatattgaatgcggactctgtcagaaaagaatacagggtccgtttcatattgattctgcagcttatcgatgacttctttcacatcgcttttcagttttttttcgaaaatcttttccagcccgtttaaatagtgctgatcgaatgaatcttctccggcatattgatcctctgacaaaagtccttttgtttttaccgctacatgaaatgacagcttcccgtttttcagcctgggagtgatggcggatgttgattttttgatctcgaaggtaatcgggtgcccccctttatccaaagcgggcagcacgccgccccgtatcgtccccatcagccaattcaggctctgtatttcgtatgatgacagaaagcccgccaatctgttttgttttgcgtttttgataatggccgctccgtcatacaccgtttttcctttttgattgctgacggcctgaatgagaaaactgagtttattatggcagtaaatcgaagctctcccgattcggagcggttttaaaatcttcccgttgtagccgccgttgttcgtaaggtcgatcagcttttccgcggccatgggctgctgctgattcggcgtcggctccgtcagaatatcggacgcttttcctcttgccgcgaagagatagctgctccgccttaattcatcatcgcggataaaatgattcatcatctgcagtatattttggtcggccagcaatttgtcgctgaatatcagcacttttaagtgatcgctgtaaacaggcggatcttttaaagcgacttcactgacggcttcaagaatggtatccccccgcgtcgtcacattgacaaacacgggccggccggaagcctggctgttttcgctttggggcagcaggttttgataggttaatttatatcggcggtcactcgtctcgtctatcgccagcccccgggcgaaagacagcttttcgacttccttcgcgtcccagcatcctgaaagcgtcatcagtatgaaaagcgccgccgcccattttatgaaaagtgtcatgacgtctttttcctcccggctatttttttcatccagctgacaaaccagatgagaaaaggaatcataatgacggcaaaaaacgcatatccgagaatattcgcgaatgcaaacacactgttgatatcatcggggtacattgaaaggccgaatgtcactgccaataagcctcccagcagccaggcattgtttttatttttcagtctgaaaatggtgtttaatccgagatgcgcccctttaaaagagccgagcatacaggtaaactgctggcatgtccacgtgattaaaagaaagatatcaaaccgctcaatgaaaatacccctgatttccaaggcatgaatcagggaaatggtcggatacgtcaccgttttggcttcagcgaccgacatacagccgatgacgacaagcagcgtaaagctgtaaaaaatgctggcgcctgcgatgccgaagacagccgcctttttcgcctgcttcgggtttttcataaacggcaccagataaagaatcacctcaagtcccgaaaaatacagaagggtccgcggaaacagctcaaaaaagcttttgtagcctccttccatgaccgggcggacgaaatccagcttaaacagtctcaaactgaatatgagcagcgtaatcagaatgacgatcgcaatcggaaacagataggcataaagctttgaaatgggatagaccccgccggtcacatggtaaatgccgaccgccagaaagatgaatatgacgacacccatcggcgtatttttcagtaaaaagtaattgatgacttcaccgagaaaacgggcttgaaaacagacggtgacgacaaaataacagctgatgaataaattcagaagagaaccgatggcgcggcccatgatgctttgattcagctcataaatggtttccccgctgtttttctgcaaaaacggcataaagagcaggacgatgccgataaacacgacactctgcacaagaataatgatccatccgctcggactgtccgctgttgcggcggagcgcggcagtgttaacacgcccgctccgatcattgttccgcttaccatgagaagtgtctgcataaacgacagcttgtcttccggttttttcatggggatcacctttgcttgattttatctttcgtctcttttctggtcggccgttttttcaaaagaggcgtcggcagtctgacgatcgtatcttttaagtcttggccaggctgcgccatgatcggaataagatagtcctgaccgaagcttttcaggcgcatcagatggccgatgacaagcagatagcacatgatcagtccgtataaacctaatatcgccgacagaatcattgaaaaaatacggatgagcctcagcggaaaattgaacgcataggagggcgccgtaaaagaagccaacgccgtaacggatacgacaatgaccatcatcgcgctgacaatattcgcctgaacggcggcctgtccgatcaccacgcccccgatcaggccgatcgtctgtccgatcggcttcggcagcctgagtccggcttctctgatcatctcgatcgtaaaaatcatgatgaacgcttcaacaaaaggagggaacgggacattcaatctgcttccggcaatcgtaaccgccattctcgtcggtaagagccccgtgtgaaacgtaacgagcgatatgtaaaggccgggtaaataaatcgtgattaaaatgcatgtataccgaagcagcctgagaaaggtaaccggaacccaccgctgattataatcgtcaggggagtggataaattcatcaacggtagccggcaccaaaagggtaaaaggcgttccatctacaagaatggaaacccttccttccaaaagagcgcccataacccggtcgggccgttcggtcgtcaagacggtcgggaaaatagaatacgtgttatcttcaataagctgctcgatcgctcctgattcgggaatgtcgtcaatggtgatggactccagtcttttcatcacttcttttacaacatcatcaggggcaatatcccgaatgtaggcaacggcgatccgcttttttgtccgttcgccgagtgtgatctctttgatctggaggttgggatcaccggactgctcgcgcaaaagcgccgtgttcgtccgaagcttttcgacaaaacctatcctcggcccccgttcaagcacttctgaagacggttcttcaatatcacgcattttaaatgtttccgtctcaaacgaaagagcttcctcccacccctccgccagcaaaaccgatttgccggagaaaatgtctgcctccgcgtccttaagtgaagaaagccgggtatgacgatagccgaaagagatggatgacggcggtgtttcagccggttcctcttgatgccgggcggccgcctgcacgggcgaaataatatattctgcaagcaattgattgtcggtcagtccgtctatatagataagacaggcgtcacatttgccgtttccgtacgtaaacgaataaaacatcatgtcatcgctttggccgaaccgttttttcagcgcttcaaggtttttgccgagctccgcatgtatcgtcacaatgttcccccctttccatcagttattttaatttgcgacaaacaaggcattttattctggaataggaaatggctgagcattccgccccatccgaatggtataatgagcaggtcagccattttatacatattgtttttaaccgcggctccctccgtgttttaaaaaagacacagggggaatgggatatgagccgctttttaaggggaggggaacgaacatgacgcaagagccgatttttttacagcctgtatgtaaagaaaaactatggggcggcacgctattacgcgaacgattcggatatgacataccttcagaaacaaccggcgaatgctgggcgatatcagcccatccgcacggaatgagcacggtcaaaagcggtccgtatcaagggaaaaccttgatggaactgtgggatcagcatagagaattattcggcggaacggaaggggaccggtttccgctgctgacgaaaatactggacgtcaaacatcatcagtctgttaaagtccatcctgacgattatgacgccgaggagcatggacagggtgaaacggggaagtctgagtgctggtacattatcgactgtaaagaaaatgcggaaatcatatacggtcacacggcccgttcgaaagcggaacttgtcaccatgattaacagcggtgactgggaaggcctgctgcgccgtgtgaaaatcaaacccggcgatttttattatgtgccgagcggaaccatccatgccatttgcgcgggggcgctcgtgcttgaaacacagcagaattcagaggccgcctaccggatatatgattacgggcgtacagatcaaaacggccaggcgcgtgagctgcatatccgcgatgccgtcaacgccgccaccgttcctcatgtggacggatttttagatgaatcaactgaaacgagaaaaggcgtcaccatcaaaacctttgtgcagggagaatatttttctgtatacaaatgggatatcagcgggacggcggaaatgacccaggacgctccgtttatgctgtgcagcgtcacagaaggaagcggctccatcctctgtgaaggcaagtccgccaagcttgaaaaaggcgcgcatttcatactgccggatcagatgcctgactttacgataaacggagattgcacgatcatcgtttctcatatataaaaccaaacttaatcccagctctgggattaagttttttttatttggaaaattgggtgatttctctctgtaaaaatgaagaaggccggccgataaataaactagtttgatagaaaccaattgaatcagaaagaggagaaggaatgaaaaagagattcgttgcacctatgttattgtccgccgttttccttgtcttttgcacccttacacagcccgcagaggccgcatacagcgactactccgtttacgagctggaaacgaagcagcaatttgcttctgagaacgaggcgcttcaagcggcagcgaaattgaaaaaggatacggggtggcaggctgacgcaaagaaagccggaaatacgccgctcacttatcaaatctcagcttcaggattacaagatgaaacggatgcgaaaaccgtgctgaaagattttacgaagcagacgggcgtgtccggcacttacagcgcaagcggaagcaaacagccgtacgtgaccgtcacatcaggcgttctatcagacgagcggcagacgaaaaatcttcttgccgaactgacgaaaaaaacgggcgtgaccggcgccgtcaagccggcggggacaaaacagccgtacatgcaggtcgtgactgctgagatggcggccgaagcggacgcaaaagcgctctcgcaagcgttgacgaagcagacgggcgtgaaagcgtcataccgtcagatcaaacgggaaacagcccggtttcagatccaatcaggaacaatctccggcgatcaaaaagccgctcaaatccaaactgattttcaaaaggaaacaggattgcaggcgtcgctgaaagtcacggcaaaggccagtccgaatatcaccgtgacagcctctgacatttcaaatgcaaatgatgcggcaggtttagcgaaacagctgcagcagaaaacgggcgtcaaagggaatgttcaaaagtatgcccatagcaaaacagcaaccgtgtacaacgtgcagtcaggatattttaacggagtaagcgccgtacaaaatgctatcacccaaatcaagaagaatacgggtgtgagcggaagctatcaaaaagccggcaagaaaaataattacacggtcgcgatgagcggactgacggctaagcagctgcaaagtgttcaagctttctttaaaaagaaaaaatggcattgcgacgcatcgcctgtcaaaaagacagcatcagtgtccgtttatcggatcacggcagggcagcttaccgctgcaaaggcagatcaaacggaggcgtttttccgccagcagcgtgtaaagacggcaagaaccgcggcgggaaaaacagcagaaaacgaatatcagctgctttctcagcagacggcagaccagtcgaggataaaaaaaggattgaatctgctggcgggatataaactgactgccatttcaaaaacgatatccaagcagacggacacaacgtaccaagtcacaaccgaatcactgcttgatacggcaaagatcaatcgttcgctggactttttcaaagggaaaaaagtatccgcctccgcacagaaaacaggtgaagcagcgtatacacaattcagaattgaaacggcaccgctgcttaaaagggaagacattgaccgcgtgactgcttttttcaagcaaaacaaagcggccggcactgtgaaggagacggggaaaaccggctctgcacagtacgtcatcaaaaccgatacattcagcagtaaaaccgttttaaataaaagcatgagctttttcagcgccaaacaattacaggccggctatacgagtgaaagccatccggtttatgaactccgcattcgcgatcaattcacgggagcgcagtcagcggacgccgcctcccaaaagctgaaaaagctgtacggatggatgatggctattttgaaaataaaaaacggaccgcaaatcatgaataccaattacaacatctcgctggcagatatggtcaaaaaacaaatgacagtcagcccgcagactgatgccgcggcttatgcatcacttacgtacatcaatacggcctccggaacggtcacagccgacgtcctgaacgtccggtcaaccccggaagtcagctccggcaatattatcgggcagttgaaaaaaggcgataaagtcagcatcacaggccagacaaacggctgggccaaactcagcatgggctggagaaacgccagcagtgacgaagtcgggcagtatgtcaatccggctcacttcgcacaagacagcaagtattactttcaatttctgaagctctctcagacagccggactgaacgcatcggaactgaatcaaaaagtgctggtcaataaaggaatactgacagggaaaggccaggcctttattacagccgccggcaaatacagcatcaatgaagtgtatttgatttcgcatgctttgcttgaaacgggcaatggcacgtcagagcttgcgaacggcattatgtataatggtaaaaaggtttacaacatgtacggcatcggggcttatgacagcaacccgaattactacggcgcacaatacgcgtataatcaaggctggtttacaccggaagccgcgattatcggcggagcccaatttatcggtgcgtcttatattcacaatccttcatacgagcaggatacgctgtataaaatgagatggtctccagccgcggcccatcaatatgcgacagacatcggctgggcgtataagcaggtaaaccgcatgtacagcttatactcactgctggatgactatacgctttactatgatgttcccgtgtatatgaaagtataaaaaaagggctgaagtgtatgcttcagccctttcttcatgcaaaaaacacccgccgtcggattcaggcaggtgcttcagcacaattcttcatttttgtttccgcaaatttcaataacgcttcactcgaattcccatctgaatacatattccatttgtctgagaaccgcttcatttcttctgcacgaaatggctttttcgtcatttcctccagaagggcttcgctgtcatgacaagcctttccgggaatgacggaagtataattgtcgattaaaccgcgttttcgatcatattcctccagatcatatgtgaaaaagaaaatcggtttatttaagagcgcgaattcaaaaggcacggaagagtaatccgtaattaaaatatcagccgctttcaagagatcatgaagacgcatgtcagacacgttcttgatcagttcgctttcaaacgaagccgaaatctgatgcaaaacggcagggtgaagctttacaagcagcatatactctccgtttaacgcgtttgtgagctgttcttcggtgaatggcagccgaaaggattgcatatcataatccctgaatgtcggtgcgtacaggatgatttttttcggccatttgtgcttcagttcgggcttgtgttcttcataatagacgtcagtcagggggacacccgtttttaacagctggccgtcccgtatgccgaacgactttttaaaaacgtcagccatcgcgtctgaaccgacggtgacaaagtcaaacgagcggtacacttttttaaaccggctgatatctgatgccggacggttttgattcgtcacatcctcaaggccgaactttttcaaagagccgttcgcatgccacacctgaatgcatgtcgtttgcggccggcggtttaagacgcttgtcatgaggaaatagttatccgttatcaccgctttgctcttaaaaaggatcaaaacagccttcaaaagatgcagcggatgtttttcgttcagataaaaagagccgataccttccagctcttttttcagactgacggcatgtctcgtatacaaaaccgtcatttcataagaaagcgattcagcgtgcgctttgtaagaacggatgagagcctgcgcattctcttcaaaagataccagcagggtcagatggttcttgggctttacaggcttgaacaaaacgccgagaacagacagatatatagaataaaaagcggcgaataaagatcgcaagttcatagattaccaatctcttttgctgttttatttgtttaaagctgtttcgtttgatcttcttcctgcttggaatacaggcttttatttgatttattatttctcaaaacggtaaaagcatacttcggaatgttcagcatccttttccatctccacggattcgtcaccagtctgtacagccattccagattcgttttgatcatccattcaggggcgcgtttcaccgttccgctgaacacatcaaagcttccgcccaaaccgatcgatacagcttgagggaaaagatgtttgtattcataaataaattgttcctgatggggatatcctaaggcgacaaacacgagatcgggtttcgcccgggaaatctgtttggcgacgaagcgtttatccgcttcataaccgttgctggctccgacaacctcaatattcggatactctttgctgatccggttcaaaacggcgtcaagcacgtcttgtttagctccgtataaaaatatttttttagactgccggtttgcgaggccgagcagcgcaagaaacacatcgaatcccgcaattcttgatttcagcgggtgctgcgtcaaacgtgacattaacacgacgccgataccatccggcaggacgaaatccgcggaagaaatgacttgatgataacctttgtctttcgccgcagcgtatccgatctcaggattgaccgtcgcaatgacggctccttgcttttgtgcgatataataagtgtctaaatatgaaataaactcctgtaaatttccattaacgtaagaaaggttgtgcaccatttcagtctgcatctgccgtcctcctttttgtacgggattttctttcactttttcgtgaattaggctaagctttattttaacataataccttcagataaacttaacaatagttttacaaaaatataaataagataacaatttctttaatcatacgcgcaaaaaccctgctaaactcctattgtaataacatttgttaataagtggaatgtaacttcattttacattggcttaaccttttcagggctatgtgatataatgaggttccatgagtacgaaattggcactttagtgattaaggatacagctgcgcagcatttcagagcagttgcttgttatacgtatgatgatagaaaggagcttttgtttcatgaagaaggtcattacttacggaacgtttgatttactgcattggggtcatattaaactgcttgagcgcgcaaagcagcttggagattaccttgttgttgccatctcaacagacgagttcaacctgcaaaaacaaaaaaaggcctaccacagctatgaacacagaaagctgattctggaaacgatccgttatgtcgacgaagtcattccggaaaacagctgggatcaaaaagtacgtgacgtagcggatcacaacatcgacgtgttcgtaatgggagacgattgggaaggcaaattcgatttccttaaagatcaatgcgaagtcatctacctccctagaaccgaaggcatttccaccacacagattaaaaaagaaattgccggggtgtaattgaaacattcggatatacagatgataaagaagtactccctccggatagggagtacttcttgtaatataaggttattttcgctatatttgttatgcgcttttgaaaaaaagctagacaataagaggagaatttaaagatgaatcttagtaacttttttaagttgaataaaaaagagtccaagccgtccgtagaagaacgcgaatataccattttaaacaaagaagcattggcggaagagaagaaggtagcggtagtcgttcctgtttataatgcagaagaatatgtaaggaaaacagttgattcagtgatccttcaaaacatcggctttcagcatatttctttaattcttgtcgatgattgctctactgatgattccagaaacatcctgactgagtacgccgagttgtatgaaaatattacagtcgtctttttgaaagacaacacgggaaccccggcttatccgagaaacttggggattgagctggcaaatgcaaagtacattacatttttggatgcggatgattggtttgcgccgaacggagttaaaatcttattcgacatgcttgaaagagatcaggtaaattatgcggtcggaaaaacgatcgaaatgcaggtgaacggtcaaaaaacgatcgggaaacatgagtcttctctgaacagagcgaaggtatcgcctttttcaatccggcatattttctatcatctcggcccgcgggcaagaatgatgaacttacaatttctaaaagataatgatatcagatatccggaaatgaaatttgctgaagataagcaattttttatggatgttcttttggcgtgcggagatatttcaacgtcaaccgagccggtctattatctgaacagaatggacaataatgagtcgctgacaaagcagactaatataatggaaaaaaccgacacgaacatagccgtaatgaagtatattctgaacaaaaaattagatactgaaaaagagaagatggcaatgaaccgcctgatcgaattcgattccattacgcgtcttttcgatcggatgcacttcctgaaaagcgaaaacaaagaagcctactacaataaattcaatgaaattctgaatgtgttaaagaagacgaaatacgatatttccgagacattttttcatccgattcataaaacagcctaccgtctgctgactcaaaaacggtatgatgaggtcgaaaagctgttccgctggtccaaaaaagagcccgataaaaacatcgtgacgcaaggcggactggcttatttagaaagcccgctgacggatgaagaaaataaactggtcgaacttcgcatgcacggagaaacggaaagcgcggtgttcgccgatcataaattcaccgttacgttccgcttgttcggacaggacagaaataatgcccaatatattcagtttcagcacagagataacatgaaagtattccaccagtttccggttcagtcactgggagacgggcggtacgtccttgaaatcccgttacgtgacattgaaaaagtcggacttggcggttatattatgtatgtcatttataacgattatgaacgtgtcatgttaaacagagacgacggtgaaaaggtgacggcagaagcgaacggactgcaatatcaattctaccggacggtgaaggagaacctttcactgaaagtaacaaaatgatgattgtgattggatatgtttaattgaaacagaggagtagacttattttatgggtatagaaaatcctgtcagatacaagttaaaacatcttaacataaaggaagagacattcagcattacgatatcctgtgaaaatgtcactgcaggggaagagccttctcttcagattataaatcgtaagacaaaagcggaactttccgtccctctgaaacggttggccggagaaggcggggagtaccatgctgtcatgagcacggatctgctttctgaccatacggacggcaaaggatgtctggatttctatgtctcctttatcaatgatgacagtgatatcagtaaaaaacggttaaaatccagccttgaacctattgaactgtcttcttataaagatgaggctcatcatatgttctttttcccttacacgacgaagaaagggaatttctccttaaagctgctgcagaaaaagtttgtcacgcggattgatgaaatggagctcgaatctgacggcagcttacatctgaaaggttttgcattccggctgaatgcggcagaaaccttaaagataaaagaaaaaaacctgattcttaaaatgaaaaaaggaaaagaagaggagcctctcattctgaagtatccgcttcacgacgtgccgagacacgaccttgatgaatatgttcaggacacaacgatgcttgacacgataggctttgatacaaaaattgatttgaatgctgtttataaagaattgaatcagcagctaacctttcaattccatattcaattcatttttgaagatgccgggacgggtgaagagattatcaccaacagcaaaccgttaaaggttctgaaatctgaacaagtaaaccctaaccaattcacgatcctgaaaacggagaaagggcctgccagatttcacgttttcacgaaaaagaaaacgaaaaatctccacctgagaatgaacgattacagcttcagcacccgcgtggagtattttgtgaaaggaaagctgaaacggggcgtttcctttgtacgcaagagaaagaataagctgaaaaagttcattgagaaaagaatacaaaacacttataaagcgggattcagggttgcggggaaactgcctgtcaaacagaaatttgtcatgtttgaaagctttgccggaaaacagtacagctgcaacccgcgggcgatttatgaatacatgagcaaagagatgccggaataccgtctctgctggagtgtaaaccccgcttactcacagacatttaaagataaaggaattccttatatcgaacgctttacgttcaaatggctgtttgccatggcaagagccgagtactgggttgtcaacagccgtatgccgctgtggattccgaaacctgagcatacgacatatgtccagacatggcatggcacgcctttaaagcgccttgccgtagatatggatgaagtgcatatgccgggaacaaacactgaaaaatacaagcgcaactttacgacagaggcttcaaagtgggattacctgatttcaccgaacgcatattcaaccgaaatattcgcccgggcgtttcagtttaataaaaccatgattgaatcgggatatccgcggaatgacttccttcaaacggataacagcccttctgtcatcaaagcgctgaaagaaaaaatgaatcttccgcaagataaaaaagtgattatctacgcaccgacatggcgggatgaccaattttataagaagggaaaatacaagtttgaccttgatttagaccttcatcaattgagagaagcgatcggcgatcgttatgtcattattttaagaatgcattatctcgtggcggaaaactttgatctcggaccgtatgaaggatttgcgtatgatttctccagctacgaagatatccgtgagctgtatatggtctctgatttactcataacggactattcctctgtcttttttgactatgcaaatctgaaaagaccgatgctgttttatgtgcctgatatcgaaacgtaccgggataaactgagagggttttactttgactttgaaaaagaagcgcccggcccgcttgtcaaagaaacaggtgacgttatcaaatgggtcaatgaaacggaatcagatgattataggcttccggattcattcgggcctttttacgagaagttctgttatttagaaaccggggaatcgtctgaaaaagccgtaaaagtgattttcggggacaagtaaataagtgcaaaaaagcataatttaaccacgttaattatgcttttttgcttaagtgacggcatgttgcgctcatgggactcaggcttgttatgaagtgaaaaatacatcgtaatctgttacaattatgagcggtgcttttgtaagtcaaagctattacctaaaacttacgactaaggaagattagaatgaatgcattggtaaaaattctgaaagagcaattcaactcatttccgctgattatgcggcttgcagtgtacgaaacgaaatcaaagtatcaagtgaactatttgggtatattgtggcagtttctcaaccctatgattcaaatgctggcttactggttcgtatttggtctcgggattcgcggcggacatgatatggtgcttggaaatggagacagcgtaccgttcatcgtctggatgctggccggcttaattccttggttctttatcagtccgacgatactggatgcatctaacagcgtttttaaacggataaatttagtgtcgaaaatgaactttccgatcagttcactgccttctgtagtgatagcatcgaatttattcagttactttgtgatgatggcgatttatattattgtgctgctgagcaacggactgtttccgacgcttcactggctgcaatatatttattacttgttttgcatgatcagttttatgtttgctttcggcctgtttaattcaaccatcagcgttttaatcagggactatcagtttttgcttcaagccgtcacaaggctgctcttttttcttctgccgattttctgggacattgcggagaaattcggaaacagacctgaagttttgaccatcttgaagttaaaccctcttttctatattatcgagggctttagagacagctttatggaagggcagtggtttttccacgatgtgaaatacacgctgtatttctggttcgtcacactgctgttattaacagtcggttcacttcttcatatgaaattcagagataagtttgttgactttctttaatatagtaaggagattatacgatgaaactaaaagtttcgttcagaaatgtttcaaaacagtattttctatataaaaaacagtctgacaaaattaaaggactgtttttcccaaacagaaatcaaaaaggttttttcgctgtccgaaatgtttcttttgacgtctatgaaggggaaacgatcggattcgtagggatcaacgggtctggaaaatcaacgatgtccaatctgcttgcaaagatcattccgccgacaagcggggagattgacatgaacgggcagccgtctttaatcgcgatttctgccggattaaacaatcaattaagcggtaaagacaacattcgtttaaaatgcttgatgatgggtctcaacaatcggcagatagacgagctttatgaaaaaatcgttgaattcgcggatatcggcgactttatagatcagcctgttaaaagctattcaagcggtatgaaatcccgtctcggttttgccatatcggcgcatatggaccctgacatccttattattgatgaggcgctctcagtaggggaccagactttctatcagaaatgtgtggaccgcattacggagtttaaagaacgcggcaaaacgatctttttcgtcagtcattccatcggacagattgagaaaatgtgtgatcgggtggcttggatgcattacggcgaaatgcgcatgttcgacgaaacgaaagccgttgtgaaagaatataaagcttttgtggattggttcaacaagctttcaaagaaagaaaagaagaaatatcaaaacgagcagattgaaggcagaacgcgggcagccgaggaacagaaaatcagtcaggcgcagcaaaagaaagcgaagcccaaattcattgccaatacgatacagattacgctgcttgcattgctggctgtcggcgcaggcgcttcgatgttttcagacaagcctctgcgtgcgattacatctttcggtgacgtcaaacagagcgatgccggcctttatgagtctgtgaataaacctgctttggtaaaagctgaaaaggcggacctttatactgaaaaagatataaaaggaaaagcctccgcaagtgtaaatttcggcacgaaggtgcaggtagaagccgaaaataaccaggcggccaaagtgaaattaaacgataaagagtactttatgaaaaagactgatctgtataaagtgaacgctttaaaaaagacggatgttcagcttaatgatttcagcggcagtttatcaagccaaacagcagaagagtttctctcatatctcaataaaagccgggacgatgtacagagtaaattgaaaaatccagctgccggacaaacggctgacggacggaacgtattaaaaacatccgatgcaaaaacggatgtagtgattgacaaggatacagtctccgaagtggtttttcatttatcgcgtcccgcagacatctcagctttaagtgaaaaaggcggcagcaaaatcaatcagaatttgctcatgcttaaaaaccaggaatatactttttctgtgaacaatgctgataaaacactgaccgtaacgtctaaaaagtaaagatcacataaaaaaagctgccggattcggcagctttttctattcgtcagcttcttctttttcaagaagatccttcatgaacggaattaatttatggcggatatcctgatcctgtaaggcaaattcaagcgtcgtctcgataaatccgagtttttcaccgacatcgtaacgttttccttcgaaatcataagcgaagacacgctgaatgtcattgagcttttggatggcgtccgttaattgaatttctcctcctgcaccgacttcctgctgttccaggtacatgaaaatttcaggagtgaaaacgtatcttcctaaaatagccaagttggaaggagctgtgcccggttcaggcttctctacaaaatttttgacctggtaacggcggccttcatttgttaacggatcgataattccgtagcggtgtgtgtcgttttcaggaacttgctgaacaccgatgattgaagacaatgttttttcgtattcatccatcagctgacgaagtcccggtttttcagcctggacaatatcatcgccgagaagaacggcgaaaggttcatcgccgatgaagttgcgtgcgcaccaaacggcatgaccgagtccttttggctctttttggcgaatatagtggatatccgcaatatttgacgattttttcactttttgaagcagttcgattttccctttttcttctaaattgcgttccagttcaggggcattgtcgaaatggtcttctattgctctttttccttttccggttacgataataatatcttcgatgccggattcgacagcttcttcgataatatactgaattgtcggcttatcaacgattggaagcatttctttaggcattgcttttgtggccggcaaaaaacgagtgcctaaacctgctgccggaataatggctttgcgtactttcttcactgaataacaccatccttgtttctgcaaaatctttttttcagaactataacctagtctttttccactttaccacaattgattaaaattcacaccttttaatccgctttcaaagagtcttgtaacggtttttgctttgtttgccattaagctttacaatatctaagaaacggcataaatatgttaacatgaagggatatccgacatataaaacgaggtgcagacaaaccgttgaaaaaactaaaagtaatgaccgtattcggtacaagacctgaagcaattaaaatggctccgctcgtattagagcttgaaaaatatcaggaaattgattcgctggtgactgtaaccgcacagcacagacagatgctggatcaagtgcttgaagcattcagcattacgcctgattttgatttgaatattatgaaagagcgtcaaacgctttcagaaattacatctcatgctttgctgaaactggacaagctgttccaagaagtaaaaccagatatcgttttggtccacggagatacgacgacaacgttcgccggaagccttgccgccttttatcatcaaatcgccgtcggccatgtggaagccggtctgcgtacgcataataaatactctcctttccctgaggaaatcaatcggcagatgacgggcgtgatggctgatgtgaattttgcgccgacaagccaggccgagcagaatctgctttctgaaaataaaaagccggattctatatttgtcacgggaaatacagcgatagacgcgcttcaaacgacagtgcgggaagattattttcatccgatttttgacaagctggaaggaagcaggatgattcttttaacagcgcacagacgtgaaaatttaggcaggccgatggaacagatgtttaaggccgtcagaagagtcgttgaagagtttgaggacgtacaagtcgtttatcccgttcatttgaatcccgcagttcgtgaggccgcagaagcccatttcgctgattcggacagggtgcacttaatagaacctctggaggtcgtggatttccataacttcgctgcgaaagcaagtttcattttgaccgactcaggcggggttcaggaggaagcgccttctctcggaaagccggtcttggtgcttagggacacaaccgagcgccccgaaggagtgaaagccgggacattaaagctggcgggtacagatgaagaaacggtgtatcagctgacaaaacagctcttaaccgatcaggctgaatatgaacggatgtcaaaggcgtcaaacccttatggtgacggatcggcttcaaaacggattgtggaagaactgctttatcggtacggctatagaaaaacccgtccgcagccttttacagaataaaaaaactctgcatcatatgcagagttttttattatttcaggctttcttttaattcttttttgactgaagcgaggcttgcttcatctaatttgtaataatagatattgttgattctcgttcccgttcccttcagttcatgctgagtgactttgctgcgggcgtttttatagtcagtcataaccgtccacatatcatcgaatgacatgtttgttttcatattgttttcaatgaccttaaacatatctccgaatttcgtgacagacgagatgtttgcccctttagaaataatcccttcaatcacttggcgctggcgctgctgcctgccgaaatccccccggggatcttcttttctcatacgcgtgtaggcaagtgcttcttcgccgttcaggctgatgttccccgttccgaaagagtgcccgtcgtagttgaaggcaaacgtgctgttcaccgtaatcccgccgagtgtatccacggtatctttgaagctctccatgtttactttcacaaaataatctaccggcacgtcaagcaggtcctcgacggtatccgcggccatctgcgttccgccgaaagcataggagtggttgattttatccatcgtacctttgccggagattttcgtatacgtatcacgcggaatgctgaccatttctgttgtattcgttttaggattgacggtcatataaatcatcgtatccgcgcgccctttgtcatttttccgctcatcgacgcccatgattaaaacagaaatcggatccttctttccgagatctatatccgtgtcacgtttgtccgattttttcaagtcttcctgaatgcttgccaccgttgaagccgctttgtgccacaagtagtagacgtagcctcctgatgataaaactaacagcccgatgattgttacgattgtcagaagaacttttttcttctttctttttcgttcagctctcatttgtcatcaccttttctattaactttcctgatacaatttactaatctttataaacccagtcatatttttacttataaccatgtaatagacgaaattcttaaaaaaaggttacaaaaagaccttaaaattaccttaaaaaaaagttagtataagacgatacataaagatgaggtgaaaaaaatgaaaaaaactattgcagctacgttcttaatactgcttttttctgttgtattggcagcgtgcggaacggcggatcaatcaaagaagggaagcggttcttcggagaaccaggctcaaaaagaaacggcatattatgtcggtatggcggatacgcacacaattgaagtaaaagtggatgatcagcccgtcagctttgaattttctgatgacttctctgatgttctgaataaattcagcgaaaatgacaaagtcagcattacgtatttcacaaatgataaaggccaaaaagagatcaaggaaatcgagaaagcaaaataatacaccatgatcagcaaaaggcgggataaaaattgaagaaaacaatatgggctgtctgtttttctgtgatattcagcctggctttattaccggaaagcacttttgcgtccagttctgatatctcagtaaaactgacgaattatattggtaataaatcgactctgaatatcgaaccttcaggaacttataaactgacgggaagcgatgtctcctccgttgccagattgggaggcgcgtccaaatatgatacggctaacgctgcgacatccaagtattggaaaaacccatccaacgtagtcgtcgttaatacggatgcttattttgcggacacgctttccgtcattcctttagcgaataaactgaaagcgcctgttctgctgactgaagcgaaaaaactgagcagcagcacagaagcgcaaatcaagaaattcagtccggataatattttaatcatcggcgggacgaacagtatttcgtcagccgcggaaaagacattgaagaaatacggccgtacgaaacggatcagcggaaaaaacagatatgatctgtccaaaaatattgcggccgaaatgggcagctatgaccaggcggtcgtagtaacgggggatgtatatacggatgcgctggcaatcgcgccttatgctgcgcaaaacggctatccgattctcctgacgaaaaaagactcccttccgagctacaatctgcctaaaaaagtgatcatcatgggaggcacttcaagcgtcagcaaagatgtggagaatcaaattaaaaagaaggcctcggtcaccaaaagaattaccggatcaaacagatatcaaatatcagcaaacgcagtcacttcgctcggcatggatgcaagcaaaacggtggctgccaacgggactaaattagcggacatcgttgtcggatcaaatattgccgccgcaaatcacatgccgcttgtatacatcaaaaaaagcgaaacacccgccgacgaggccagcctttttaaaacgaaaggcacctattcttatacattaataggcagcgcaaattcaattgccgattcagttaaggctgcttacgcaaaagagttttatctcgtaaacggaaagacataccgtattgaaacgtccggcggcaaattaggcgttgcaggcattaacagcggaaaaacgtctttcaaggcggttcctgaaaaatattcaacagcaaacacaatcagcattgacgggaagccatatctggggaatatgagtttcactgcggaatccggcaaatatgtaagacctgttaatgaaaacattccttttgaggattatctgaaaggtgtcctgccgaatgaaatgccgggaagctggccgacagaagcgctgaaagcccaggctgttgctgcccgcacctactctatcggcaagatgggacaaacagtcgcggatacaacggcctttcaggtttacgggggatacagctggtatccaaacgccaccgcagccgttaacggaacaaaagggaaagtgctcacttattccggcagattgatagatgccacttactcatcaagcaatggcggttacatggaatccggcgatgaagtgtggggatcgaaagtgccgtatttagtagccaaaaaggatacaaaagatccggaaatcagctggtctttaacattgcagaagcagcagctgccagcgggtctggatatgaaaaaccccgcatcctggtggtctaaaacaaacgaagcaaatgccgcgcagctcaacggaataaaaaattggctgatgaaaaataaagaaaccaatgcaagttccataaaaattgcaagcatctctgatctctcgctcaccggaaaaacaaaaggccagcgcgcggaagacgccgcggtgaaggtcacgtaccatgtgaatgacaagtcgaagggctatgtcatgaacaagactgcatctgttgaggtgaaagcgtctgaactcaggacgatgatcggagcttcatcttttaaaagcacatacgccagtgcgtccggtaattcttcgcaaatcacgatatcaggaaaggggtacggtcacggcgtaggaatgagtcaatacggagcaaaagaaagagcggaggccggagagccgtatacttctattcttgcgttctattatcctaatacagcacttacaaactactaaacttctgtggaggagatcggattgaaattcatcataaaatgtctccccgtctttattctcggggtcattctatttgtcccttccgctttggctgacaacacggttaaaaggatcggcggaagcacccggtatgatacggctgtactggcggcaaaacaatcatggggtgaagcgaaaacggtcattatcaccggcggaacttcatatgccgatgcaattgccgctgcgccgctttcatatcaaaaaaatgcgccgctgctgtttacaaataaagatcagctgtctgccggcacaaaaaagggattaattgatttaaaaacgaaaaatgtgattatcgtaggcggcacacctgccgtttcgaaaaatactgaaaatcaaattgctaaattaggcatcagtgtcaaacgattatcagggagcacgagatatgccacagccgcaaaagtggcgggtgaaatgacaagatcttctacagcccttgtggtcaacgggtttgttgatgcagatggaatggctgcgatttcttatgcgtccgctaaaaaatatccgattttattcactaatgattcgacattaaatggttctacgtccaatgcgatcaaaagcttggggattaaaaacacgattgtcatcggcgggacaagcagcatcagcagctcactttacaataaactgccgaacccttcaagaatcagcggcaaaaaccgctataacctgtctgtgaatcttgcaaaaaagacaggcttaagcacaggctatacgtttgttaccaatggctttaaagaggcggataccatcgtcggaggcgtgctgagcgccaaacagggaagagttcacctgctgacgaatggagacagtctgtcaaaagacgtccggacgtatatcggaagtaaaaacatcaccagcttcactgtcataggaagtgcttcatctttaagcaacaatgccgcgtcacagcttaaaaatccggttgtcggcaaaacggtctttattgatccggggcatggctatcaggattcaggtgcaaccggaaacggcttgcttgagaaaaatgtaaaccttgatatcgctacgcgtcttaacaatcaattatacggcgcgggcgcgcttactgtaatgtcgaggaagggcgacacctttgactcgcttgaggagagagtgaacaaaggggcgaaggcgaacgccgatattttcatcagcgtccatgcgaacgcaaatgataacagcagtgcaaacggtacggagacgtattatgataaaacgtaccaatccgcaaacagtctgaggcttgcccaaaatattcagccgagaatggtttctgctctcggcacgcgtgaccgcagtgtgaaaactgccggattttacgtcattaagtattctaaaatgccgagtgtcttgttagaaaccggttttgtcacaagcccgattgatgccaatattttaaaacaatcaacgaaaaaggacagactcgcggcggggatcacccaaggcgtttcctcctatttccgataattttttcatggaaacagaccggttcataccggtctgtttttttatttttcattatgctttgtctcaaatatggatatgaatagatttacaataaaaaaacaataatcgaaacattctaataaacattaacgcttcctttacttccaattaacatccatctgctaaactcacggcataggtcatcaaacatcccaacaaatcgtgaggtgtgtgtcagtgggagcagagaaaagcatgaatgtaaataataactatgcagtgcggcaggggacttccgctgccgttacggaaagaacggcccgttatttggcttttaagcgattcatggacattgtgtttgcgcttgcggggctcttggcggcgctcccggtgatgggcctgttctccatactgattcgtttggagtcgcccggcccggctttttataagcaggagcgggtaggcaaagacgggaagccgttttatttgtataagctccgctctatgaaaatagatgctgaaaaatcgggggcggtctgggcgctgaaaaaggatccccgcgtgacaaaggtcggcgcttttatcagaaggacccgtattgatgagctgccgcagctggtaaatgtgcttcggggagaaatgagcctgatcggcccgcgtcccgagcgtcccgtgtttacggaacagtttcaggctgagattccggggtttacggagcggctggccgttaagccgggattaagcggctgggcgcaggtcaacgggggatatgacatgacaccgagggaaaaactgatgtttgacttatattatatccgcaacctgaccttttcattggaactgaagattatgctcaaaacgtgcaaagtgatctggaccggtgacggggcgcgataaaaattctggtcagcagacaaaaaagtagggaaaacgatgcctagtattacaaatcaaatcttgagcggcgccaaatggacaagtatttcgacagcgtgtattacggtcattcaaatcgtccaattcgccctgctcgggcgggtcatgtcactggctgaattcggccttgtcggcatgatcacaacggtagtggtgtttgcccaaattgcgctggatatgggttttggcgccgcgctcattcaaaaagatcatgtgactgataaacagatgtcttccttgtactggctgaatatcataacggggcttgcgctgtttgcgctgctgtttttcagcagtccgctcatcgccgatttttatcggcgggaggagcttgtctatttaatccgcgtgctggccgttatgtttttaatcgcgccgatcggtcagcaataccagtatatgctgcaaaaagcgctggcatttaacacgttaagcaagattgaaatcttttcaaatgtgctgtccttcgtgtatttggcggccgcggttttttatacggacccgattctcgcctatgtgatttctcaggtgctgctgcaatcgtcgaaagggattctgtactggatggcctgcagaaaaacatggagaccggcgttggtttttgatctgaaaggaatgaaaggtttcttttctttcggggcctttcagctgtcttcccggcttgtgaaccggctcggagcgaatattgatatgattctgatcggcagttttatcggcgctgaggcgctcggcatttacaatctggcctaccagattgtcacgcttccggtattaaaaattaatccgatcattacgagagttgcgtttcccgtctttgcgaaaaacaagcatgaaaacagcgttatcagagaaggatttctcaatatgaccaaaatactcgcgctgatatcctttccacttttgctcggtttggtttcagtgtcggatgcattcgtggcttcggtattcggagaaaaatggctggcggctgtcccggttttaaacgttctcgccatcgtcgggatattaagggttctgatgaatccgaacggatctgtgctgctcgcaaaagggcgggccgatctggcgttttattgggacgccggggtgatgctgctgtatggtgcatctttgtacgccgccgtgctgtccggaaatctcttgacggtagcctggacgtacgctttcatcagcatcctgaatttcctgatcgggcgctggctgttggcatatgtcattaagctgcggctgtcggcttacttcaaagccgtggccaaaccgtttgtgcttacggcggcaatgggtgtcatcgcctttacagccagcttcggcacggagcggatcagccttgatgtcaagctgcggctggcgatctccgtagcctgcggcgcgttgtgttatttattcctgttaggaaaagcttatccgcatatgaaaagtaaattaagaaaaggacgtttgctatgaaggtattgtggatgacaagtgtctatccgagcagtgagaagccgggagaaggcgtttttcatgagacgcaggcccaagaactgagaaggcttggcgcggagatgaccgtcatttgtccgcggccgaaactcgccgcgccattccgggtgctgaaaaagacgtatcggcaaaaggatatcaggccggcgcatgaatggcggaaaggcgtgtccgtccaccggccgttttatcaggcggttcccgggcagctgaaatgggcgcagccgcataaaagaatggcggaatccattctttccgaaattaaaaatcatggcctgaagcccgatctgattcacgcgcatttcgccatgccgtcaggcggagcggccgccattgtgtcaaaggctttaggcattccgtatgtgctgaccttgcatggcagtgatgtcaatgtctatccgcattacagcaaaagcgctcatcgcgcatttacatttgcggtgcgggaagcagccgatatttacgctgtgagcggcagtctgcgggaacaaatgaaaaagcttatcgaagcggagtgcaccgtgcttccgatcggcatcacgcttgacgccttccgaaaaaggaacgagacgaaagaagccgtcagaaaacggctcggccttcctccggataaaaaactgatcgtgttcatcggcaggcttgtcaaagagaaaggtgttttcgacttatcaaaagccgctcagtcattggatgaaagatatgaagccgtctttgtcggtgacggttccgccgcatcttcattgcgtgaagccgctcatatcgtcacggggcaagtgccgaacgacaaggtacaggactatctgctggcttcggatgtaatggcgctgccgtcctacagcgaaggcatgccgactgtggtcattgaggcgctcgctctgaaggtgccggtgatctgcaccgatgtcggaggattggcttctttattcgggaaacaccgggggttgctgatcaagccgggttcacctgagacgcttgcagaatcgattctgcaatatgacgaaggagaggcttggacgccgcaaacagccgaggaactttatcaaaccgtccgcacgtattttgacgcaagccaaaacgcgaaaacgctgaaagagaaataccgatccgtaatgaaccgggccgggcaagaggagaacctttcgaaagagggatgaagctgtgaaaaaaatcgctgtattaggaacagggtatgtaggtcttgtatctggaacttgttttgcggaaatcggccatcatgtgacttgctgtgacatcaatgaagcgaaaatcagaagcttgcaaaacggagtcatcccgatatatgaaccggggcttgaggaattagccgaaaaaaatgtcagtgccgggcgcttatcctttacggccggcattgagccggctgtgaaagccgctgatatcatctatatcgcagtcggtacgccgatgtcaaagacgggtgaagccgatctgacctacattaaggcagcggcgcaaacaatcggagaacagctgaacggatacaaaatcattgtcaccaaaagcactgttccggtcgggacgggaaagctcgtttaccaaatcgtcaacgaagcgtcaaagggaaaatatccgtttgatgtcgcgtcaaatcctgaattcctccgcgaaggttcggcggtgcgggatacgatgcagatggagcgggcggtcatcggcgccacaagcgaacatgccgcttcggtcattgaagagcttcataagccgttccgtacgaagatcgtaaagaccaatcttgaaagcgcggaaatgattaagtatgccgcaaatgcttttttagccgccaaaatatcttttattaacgatatcgccaatatttgcgaacgtgtcggggcggacatttcccacgtgtcagaaggcgtcggtcttgacagccggatcgggaataaatttctccaggcgggcatcggattcggcggatcctgctttccgaaggatacaacggctttattgcatatcgcaaacgccgccggctatccgtttcaaatgatggaagccgtcattgaaaccaatcagaagcagcgggtccgtattacggaaaaattgaaccgcgccatcggtcccttaaaagggaaaaccgcggccgtactggggctggcctttaaaccgcacacaaatgacgtccgctccgccccggctcttgatatcatcacaagtcttaaagagcagggcgctcacgtgaaagcgtatgatccgatcgcgattcccgaagcgtcagcgatattaggagacggcggcattgaatatcacacagagctgtacagtgccatcaaaaacgcggacgcatgcctgattacaacagattggccggaagtcaaggagatggatcttcagagagtgaagcagctgctcaaacagccggtcatcattgacggcagaaatatgtttccgctggagtatatgagggtttcaggattcacttatcattccgtcggacgtccggcggttcatgccgatcggcaaataaaagaactggcaagatagaaaaagattgtcttcaggctctcggcagcccggctcggctgccggttttggaaaggggtttgccatgtgagtatcaaacgttcagcggcacatgttcttgtgctgcttgccgctctcattacaggaggattcatcatgctggaggcggtcagggcggatgccggcttcggaaaaatcaccgtgctgctgcttgccgccatgatcggtattgccggacttgctttgctatccgcctttacaacaaacggtcagatgtttatggggctcatttatatactgatcgcgtgtacatttttaaaccaggccttctttgcggtccatctcggatttttcagcttatttatataccggctgttattaatcggagcgggcgcccttcacatcgccggcatcctgacaaaccgccatcatattgacagatggaatcgggtgaatgtaaaaggggttctgatgtttttcgccttatggtttacatacggtctcctatcgttattgtgggcaaaatccgtgacgtacgggattaaatatttagctttaatgggaatgggcatgtttttgatttatcttattgtcatgttcattcagcgctttgatcagctgatggttttttacggcatatggcttgtgatgaccatttttgtgatggcgatcggcttttacaaccattttacacaccaccatctgccgagctccacgctttataacggcccgcagtacaaacagcattatccgacgtccgttttctttaatcaaaatgatttcgcaacgtttttgtgcatcagtttctttctgtatgcggcggcggtgaaaaatatgaaaaacggctatgtgaaggccgtcagcctgctctttgcgatctgcgctttgtatttaatcattttgaccggttcgcgcgcgagtctgctgggcatatgcgcgggggcggctgtatacgtcttcatcctgctgccttccctgttgaaaaaactcgcgctgtacgcagcgggagcgggtgcggcgctgtttgcggttttatttgcgggccgtatcaccaatgccgtcttgaatctgttttcagctccgcaggcgatgccgggacagcaaccgcttccttccaaccttgcgagggcgaatcttttaaaaaacgcctttcactatgtgattgattcctgggggttcggagtgggtgccggaaacgtctcttactatttaaaagcggagcccgtttatgatacgggcggcgtagttgaggtgcacaactggctcgtcgagattatggcgaacttcggcgttcttacgatgctcggttacctgacagtctatttgttccttttttggacactttataaatgtcatgaaagaaaatcggaaaatcagtcaagactgatcacagaaggacttatcacggcgatggccggttttttggtaagcagcatcagcccaagctccgtatcaaatttatttttccactgggtatttctctcgctcgtgatcgcggcggtcaatatattgaggcgtttacaaaaggagcctgccgtcacggcgtactatgaaaaacagggagatgcgagatgaaggatatgttgacaagaataacccggcgtatcaaaaagaatatcatttggatcattgcgctgcccgttgtgttaggggcagcgggatatgtattgccgtcaaaaatcagcgggggcagcagttttacatcagaagccgcgatcgccgcgggaaattatgatcatccgctttataacaatacaaaagaaatcccgctccttttgacgagcgatgcctttttaaagcaggctttgcctgataaaacagacgaagaaagagcggccgtgaaaagtaaactgactgtcgaaacacaatcagattcattgatcacggtcagctacagcggccaaaacaaacaggagaccgaatcggtgtttcaagccgtcataaaaacttttctgaagattgatcaggacctgtttgaaaaacgggcaaaagtagtgcggcagagtattgctgcgcttgaaggagaaaccgtcagcgcggacgccaaagtggataaggaacgatttttatacgaattgaaaaatacgcagctgaacctgaaagcggccggcatcatcaattcagagccgatgaatgaaacggcgggacaaggcatgccgccgaaaaagaaagcggttctgggcgttttaatcggcattgcagttgcatttatgttcattgtcattcctgagttttttagagagtccttgtaaaaatctgcgatggagatgtgaccatgacaaactggaaacctttcgtatctgtcattacaccgtcttataatgcaagtgaatatatcgaagacacgattcagtccgttttacatcaaagccacccgcattgggaaatgattatcgcggatgattgttcaacggacggaacgagagatattttacggcaatatgaacaaaaggatgagcggatccgcgtcgtttatttagataaaaacgggggagccgcggctgccagaaatacagcccttaaacatgccaagggccgttatgtcgcatttctggacagcgatgacagatggaaaaaggaaaagcttcaaaaacagcttgcgtttatggcagagcggtcctgcgctttttcatttacgggctacagcgtcatggagcaggacggaacgccgacggacaaaacgattcaagcccctgaaagcctgtcatatgatgaagctttaaaaaacacgattatcggatgtttaacggtcatgattgacagagagcagacggggcagattcaaatgcctgatatcagaacgcggcaggatttagcgacatggctttccctgctgaaaaggggatttacggcttacggcctgaatgagtgcctttcagaatacaggcttgtgcagaattcgatttcaagtaacaagtggaaagccgcaaaaaaaacgtggtttgtttatagagaaattgagcgcctgcattttatcaaggcttcgtggtgttttatgcaatatgcaaaaaacgcggtcttgaaaagactgtaggcgtcagaggagctgggtgatgaaggtggaaccgattattcacgtaatcgtcggagcggcggaatgggggcatgaccggctgagatacagacggcaccggctggctgaatttctcgcccggcaaaaagaaacgaaaagcgtcatttgggtatgcccgtctccgcgagccaatgatggtcagatggccgggatcgccgagggaatccggcagttcactgtaaaggatctcatgcggcaaaaagctttccgcttcggcaggtatacagacatgtgctacaggcataagctttcaccattggtgaacatgctgaaggaagaaggagaaggggcccgctgctgcttatggtacaccttccccggttttccgcttctggcagatctgtttccttgggatgaagtgatttatgattgcagtgatctgtgggccgctccgatcagcggccgatccggggtgctgtcaaatgttagaagaaacatcattaaacaggcggaaatgagaatcattcagcgtgccgattccattacgtgtacatctgactgtctgcaccgggaggtcggaaaaaagctggagaatccgcaccagaaagtgttcaccattgaaaacggagtggaatatgacctgttttcacgggaaaataaacagccggatgaagacattttacggggacggaacggaacggttctcggttttatcggcggaatcaaaccgaagctcgattttgcgcttatggcggaaacggcagatgtgaggcctgactggacgattttattggtaggcccgaacacggctcaggacgatccggatttcaagtcgcttctggagcgtccgaatgtcatctggacgggacctgccgcgccgaatgaagtgccgtcctatatgcagcttgtcgacatcggcatcatgccgtataaaaattcaccttataatgacgcggtatttccgcttaagctttttgaatttttagccgccggaaaaccagttgtcggctgcaacctttcttctacgtcaaaaatcaaaagacctttcgtctatgaatacgttgaaggcagtgaccccgcagatttcatcgcggcctgcgacgcgcttctggcagcggaccgcagcggatcatatgaggctttgcgccgtgaattggcccggagacgggattggaatgttttattcggccgaatgctcgaatgcacgggtatattgaaaaatgcgcaatcccattaaaagggaaagcgcattttttgatttgcgtgtttctttttgatgatgcttgttataataactagtaagaattataatggaaggaacggttcaatatcagaaaagacttcatataattccaaaggagacttctttatgcttgacgaacgcatgtttcgcatagttgttgcgttttttgtctctctgctaacggttttaatcctaactcctatcgtaaaaaaaattgcgatcaaaataggtgcagttgaccagcccagcaaccgaaaagtacatgataaaataatgccccgtatgggcggcctggccatctttatcggcgtagcggcgggtgttctcgcggccggcatatataatgaaacgaaaatgaccgccattacagtgggtgcgtttattattgttattttaggaatccttgatgataaataccaattaagcgcaaaggtaaagtttttcgtccagctggccgtggccattatgattgtgagcacgggactgaaaatggactttttctccgtaccgtttttaacggaacgtttagaattgggatgggtcgcttacccgctgactgtgttatggatcgtcggtattacgaacgcgatgaacctgattgacggtttggacggactcgctgccggcctgtcggtcatcggactctccactatcgccgttatggcgttatccggagggaaaatccttattctgtcactttcacttgtcgtgataggaagcacactcggatttttattttataattttcatccggcaaagatatttatgggagataccggatcgctctttctcggatacgtcatctcagtactctcattattaggtctttataaaagtgttacattattcagtatcatcattccgatcatcattttgggcgtgccgatttttgatacgacattcgccgtcatcaggcggattttaaacaaacagccgatctcagcgcctgataagtcacatatacaccaccggctgatggccttcgggctgtcacaccgcacggctgtcattatcatttatttaatcggctttattttcagcgtcagtgccatcctgctgaaaagcgcgaccatatggctttcgctgtttattatttttgtattgattgtatttatgcaaatcatagcagaggtcacagggttagtaaatgaacaatttaaaccatttaccaagttttacaagagattggtaaagaaaaattaaaaagagcagatcatgcgaatggtctgcttttttgtggattctgctattctgctattctcttattatataaaaaaacccgatcctgctcaaaggatcgggtttactcttaatagcctgttgtgccgccggactgtgtgctgtccgtaccgtttgcaccagcagtaccgttggttgaatcggttgtgccgcttgttcctgtgctgccggaagttgaatcagccgtaccgcctgttcctgtgctgtcggaagtcgaatcagtcgtactgtccgttccggtgctgtcagaagcaggatcggacgccgtgctgcttccggacgggtagtccaggtgtttctgcaattcctgccgtactttttcgagattggtcggatcgggctggaaataatacgttccgcccgtagacgcggttccgccgccgcctaaatataaatctgatcctgttatggtcagtgtatcaatctttttgctggtaaagccgttataaatctgctgaagggcgagtccttcagtgattcggatattcgtttgtacatttttgcttgctgtttcagcgattttatcgattttagcaatatttccagccttagacatttggtcgatcagtgcatttaggatttgcttttggcggtcattacggccgaagtctccgcgtttatcctgctttctcatgcgtgcgtaagccagagcctgctcaccgttcaaatgcatgtttcctttcttgaagtagatccgtttctttttactgacgtcactcatctcgtcgaagtcaaaaggcacttttacattgactccgccgacttcatcaataacatccttaaagccgttaaaatcgacagtgacatacttatcaatcggtatgcctaataagtcttcgacggttgagacggtttcatccgccccgcctttagcaaaagccgcattgatttttgattttttaccggttgtatcgccggcaagcgtcacccgcgtatcacgcggaatactcagcattttcattgttttatttctcggatcaagggtaacgacaataagagagtctgatcgtccgccttttccgcttgtggcataattttcgatccccataaacaaaatggagaacggttttttcttcatatcgatgactttatcccgaagttttgatttgtctccgcgggaaagggcatcatatgcattatctgccgcattgatcgttttgtatactttgtatccgccaaacccggcagcgactaacaaaacgagggtaagcagcagcaaaatccgtttgaatatgatctttcgtttgcttttctttttctttcgaacacgcactcttacacgttcagccattacattagtctcctttagggctgacgtctgtttctaaatacgtcagttctccctctgtattcttactcttgccgttcgtcagctctgtcatccattttataaactcgtctttgtctttttcttcaacgtacgtttcaaattcgacatgatccgcataatggatatctttcagtaaaaaaactgattctctcagttcgttctctatcttgccgagccacgtataatccgctgatgtatgcataatccgcatcagcttccgctccgtaactcctatatgatttaagccttcagacactgacttcccatatgcacgaatcaatccgcctgcaccgagctttattccgccgaaataccgggtaaccaccgcgcaggtatctttcagaccgcgttttttcagcacttccagcatggggacgccggctgtgccgcttggttctccgtcatcattcgccttttgtatatggtcggtttcgccgatcagataagctgagcagttatgagtcgcattccagtgctgtttttttatcttttgtataaattcctgcgcttcctcttcagaagcagcacggctcaggtgacagataaaacgcgatttttcaatcacaatctcatgttcacccgtttctttaactgttaaatagctgtgcagcatgattgctggaccctcctgacaagcattaaaagacttgtttctacaaattcgaacagactttagaatttttgcgcatattttggtatcatgaaagagtaagatactatataaaaatgtttttttctagaatatacgcattctttcattataattcgacataaattgcagttcaattacatttataataaaaatacataacaacaccgttacggagggagacagatgaataaatcgaagatggactccaaagttttggattctatacttatgaaaatgctgaaaaccgtggacgggagcaaggacgaggtttttcaaatcggagagcagtcgcgccagcaatatgagcagctggttgaagaactcaaacagatcaaacagcaggtctacgaagtcattgagctgggcgacaaacttgaagttcatacgcggcacgcacgaaaccgcttgtctgaagtaagcagaaatttccataagttcagcgaagaagaaattcgcaacgcctatgaaaaggcgcacaaacttcaagtggaactgacgatgatccaacagcgtgaaaagcagctgcgggagcgcagagatgatttagaacgccggcttttggggcttcaggaaatcattgaacggtcagaatctttggtcagccaaataaccgtcgttctgaattacctgaatcaagaccttcgccaagtagggcttcttcttgccgatgcgcaggctaaacaagatttcggtttaagaatcattgaagcccaagaggaagaaagaaaaagagtttccagagaaattcatgacggtcccgcgcaaatgctggcaaatgtcatgatgagatcggaattaattgaacggatcttccgcgaccgcggcacggaggacggatttcaggaaatcagaaatctgcggcagaatgtgcggaatgccctttacgaagtcagaaggattatatatgatttaagaccgatggcattggacgatctcgggctgattccgacactgagaaaatatctttatacaactgaagaatacaacggaaaggtgaaaatacattttcagtgtatcggagacacagagaaccaaaggcttgccccgcaatttgaagtggcgcttttccgtctcgctcaggaagccgtcacaaatgcactcaagcattcagaatcagaggaaattacagtaaaagtggaagtaaccgctgattttgtcgttctcatcattaaggacaacggaaaaggctttgatattaaggatgctaaacaaaagaaaaacaaatcattcggcttgctgggaatgaaagaaagagtagatctgcttgaaggaacgataacgatagactctaaaataggtcttgggacatttatcatgattaaggttccgttatctctcggcctataatttgttaaatagagccaaaagacatattgaccgaacagcggcgtatatagaacaataggataaggaggcgtagcgtgtgactaaagtaaatattgttattatcgacgaccatcaactattccgtgagggtgtaaaaagaatattggattttgaacctacctttgaagtggtagcagaaggtgacgatggagatgaggcggctcgaatcgtcgagcattatcatcccgatgttgtcataatggacatcaatatgccgaatgtaaatggagtagaggctactaaacagcttgttgagctgtaccctgaatctaaggtgattatcctctccatccatgatgatgaaaactatgtgactcatgctttaaaaacaggtgcaagaggctatctcctgaaagagatggacgcagatactttaatcgaagcagtgaaagtggtagccgagggcggttcttaccttcacccgaaagtaacccacaatcttgtcaacgaattccgccgtcttgcgacaagtggagtttctgctcatcctcagcatgaggtttacccggaaatccggagaccattacatatattaacgagacgggaatgtgaagtgctgcaaatgcttgcagacggaaaaagcaaccgcggaatcggtgaatcattgtttatcagtgagaaaacagtgaaaaaccacgtgagtaatattttgcagaaaatgaacgttaatgaccggacacaagccgttgtcgtggccattaaaaacggctgggtagagatgcgttagccatgtgtgagaagacttgcctgttatggcaagtctttttttacagctgcatatctattaaaatacttattaagtacttaataaggcaggtaaagtgatgaagattgcagttgtaacagacagtacagcatatattccgaaagagatgagagaagaacatcatattcatatgatccctctccaagtggttttcggtgaaaaaacattccgcgaagaaacagaactcgactggagaagtttttataaagaagtaaaaaatcatgatgagctgccgactacgtctcagccttctttcggtgaattaatcgcattgtacgaagaactgggcaaaacatatgatgcagtcataagcatacatttgtccagcggaatcagcggaacatataacagcgccgcctcggcaaacactatggttgatcatattaaagtttatccctttgattcagagatcagctgtttggcacaagggttttatgcgttaaaggcagcacagctcattaaagacggtgttgactcaccggaagagattataaaagagctggaagaaatgaaaaaaacagtccgtgcgtattttatggtggacgatttatcacacctccagcggggcgggcgtctaagcagtgctcaggcttttatcggcggtctgttaaaggtaaagcctattcttcattttgacaataaggtaattgttccttttgagaagattcggacacgcaaaaaagcgatttcgagaatttttgagctgtttggggaggatgcaagtaaaggaatcccgatgcgggccgctgtcatccatgcaaacagggaagaagaagcggcggctattatacaggagttaagcggtaaatatcctcatgtcgaattctataacagctatttcggtgccgtgatcggaacccatttgggcgaaggcgccatcggaatcggctggtgctttaaaaactaagtgaaaatctccgttttcaagggcggagatttttttattttttaattttcgcaattcgacaagtgggttcccgacaaggcatactttgagcagaaaggaggcagggagatgtccgaaggtgcttcagaattttcagaggtgcgggatttcttttacggccggcatttattgagatctgagataccgttttcagaccagcgcattaagcgttttacagaaaaagaatatataacggccgagccgtcaatcatccgccggaaaaatcgttacgtctgccaacgatgcggtcagtctgatcaagcctgctttgcggcattttgggcgccctctgccaaaaggcagattacctattgccgtgcctgtgtcatgatgggaagggctgatgaactgacatcattatattcttggaatcaaacccctgaaaacagctgggagcctgtaaagctttcttgggaaggaacactgacagacggacagaagcgggcggccgccgcgcttacagatgcgataaaagagagacaagagctgttagtatgggcggtttgcggatcggggaaaacagagatgctgtttccgggtatcgagtttgcgctgaatcacggtttgcgcgtctgtgtcgcgactccgcgtacagatgtcgtacttgaactgctgccgagactgaaaaaagcatttgagaaagtcgaagtttctgcttggtacggcggcagcgaggacaaaggccgtctgactccgttaatgatttcaaccgctcaccagctgatgcgctaccgagacatttttgatgtcatgataatagatgaagtagatgcgtttcctttttcagccgatgagacattaagattcgctgttgataaagcgaggaagaaaaacagcgcccttgtttatgtaacggcaactccttcagacacattaaaaaagaaggctgaagccggtttgctgaaaagcgtccgcataccggccagatatcatcggaaacccctcccggagccgcgttttttgtggtgcggcaattggaagaagaagcttcagaaaggaaaactgccgcgctctgtaacggattgggtccgccaaaaacttcaatcacagctgccggttttcttattcgttccgtctgtacatgtattgaaaaagacaacggattattttcagaaattaaacatacgggcagaaggcgtacatgcggaagacacattcagaaaggataaagtgaaacggttcagaaacggccggcttgacctgctggtaacgactacgattttagaaagaggggttaccgtgcccaaagttcagacatgtgtcctcggcgcagaagcacctatctttactgagagcgcgctcgtacagatcgcaggcagaacgggaaggcattataaacatttcagcggtgatgtcgtcatgtttcatttcggaatgacaaacggaatgaaaaaagcaaaaaaacatatagaacatatgaacaaattggcacaaaaaagtaaattgttggactagttaatttcagaaaacatgatacagtatactcatactttcctatgaggagctgtcagcatgcttgtcaattcaaaagaaatcgtattaaaggaacttctcgaccgccatatgtctcagcttcatatgaaatgcacatgccgggtatgcaaaaatgatgtactggcactttcacttaaccgggctgaaccggcatatgttacagataaaaagaaagttgcttatgcaaaagcagagatagttgataaacagaaaaatacggcgctgcttgtcattctggctgaatcagcggcgattgtttcggttaatccaagcgagttctgtgaaactcgggaaggagcgtaatatctctgaattgtttattgtgtgactcaccaatttcaagttcattgacttggagatctctattttctctggcgcccgagcaagaggtatgcagcatatgcagcagccaattcgaaaaaattgaaggccccgtatgcagtatatgcgggaggcctcaggagtcaaatgaaaaatgcgctgattgtgcggcccgggaatcaaaaacggaaaagcgctttttgctgcggcaaaaccgttcggtatatttatataatgatgcgatgaaggactcattggcccgttttaaattcaggggtgatgcaaaaatcattcaagcatttgaacgtgactttgctgccggctttaaagcggcatatccatcaaatacacatactctcatccctattccgctgagcggcgaacggctggcggaacgcggattcaatcaatccgagctgctggcctctctgctcggaatgcctgtcatttcccccctcatccgactgaacaacgaaaaacaatccaaaaagagcaaaacagataggctgtctgcagaaaaaaagttttcagcagccgaaaactccgccgaaggtatgaacgtcattttaatagatgatatttatacgacgggcgccacacttcaccaagccgccgaagtcctgctgacagcgggcaaagcgtcatcggtctcctcttttactttaatcaggagctaaatcattctttttttctgccgatataattgatagaaatataaggcagattaaagaaggaataggagttaataagatgggtgaattggcgaattgtccaaaatgcaatgctttattttttaaaacgaacctgcagaccgtgtgccaggcatgtattaaagaagaagaaaaagcatttgaaaccgtctataaatttttgagaaagcagatcaacagacagtcgacgatgcagcagatcactgaggaaacaggtgtggatgaagagctgatcctcaagtttatcaaacaaaaaaggattcagatcagccagcttccgaatttggcatatccttgcgaaaggtgcggaaatccaatcaggacggggaaattttgcaagtcctgtcagacagatattgagtcgcaattagaccatatgaaccaaaaaacagccgctgaattcgaagataaaaacagtacaaaagacacatactatgcctataataccaaaaacacctgattccctaaactaactgataacgcagtcgataaaagaattagactgcgaacagaaagcgagaggaatcctatgaaaatcaatcagtacggaacacaatccgttaatccataccaaaaaaattacgaaaagcaagccgtacaaaaagaggctgcaaagccgaaggacaaagtggaaatttcttctcatgcaaaagagcttcaaaatgcgtcagatgcggtcactaaaacacgacaggaaaaaatcgctcagcttaaagcggatatagagagcggaacatataaaatagattcaaacagcatcgctgaaaatatagtaaatttctataaaaagcaataaaaaggagaaagccaatgtcagcaaagccaattattgatcaactgaagcgactttgcgcactgcatgaacatctgctcacgctgtctgaggagaaaacggaagcgctgaaagcaggtaaaacaaaagagctctccaacatattgaccaaagagcaaaagtatattcaggcaatcgggcagactgaggaagaacgaatcaggttaacttctcagtttctcagccgcggtgaggacaatacaattgctgcatgcatctccagaacttcaggcagtgaaaaacaggagcttgaagggttatttcactctttgtctgcgcttcttgaccgtctgaaagaagtgaatgagatgaacaaacagctcacgattcaggctttacaattcatctccggggcattcgatatgatcatgccgggtgaaaaagagaatatgaattataaagagccgcaagcggcgcgcaagcctgtcagccgtttgacattattcgattcaaaagcttagaacggaggattttcaatgccatcgacttttatggggctggaaacagcaaggcgtgcattgagtgcgcagcagactgcattgagcacagtttcaaataacgttgcaaatgcaaatacagaaggatacacgaggcaacgcgtcacattacaatcgacgagcccttatcccgcagtatcaaaaaacagtgatctgacggccggccaaatcggaacaggagtaaaagccggttcagttgagcgcgtcagagacagttttttagactatcagtacagaactgaaaatacaaaattagggtactatacagcccgttccaattcattgtcgcaaatggaaggcgtcatgaaagagcttgacgataacggattaaacggatcgctcagttcgttttggaatgcccttcaggatctggcgacgaatccggaaaatacgggagcgcgctcagttttgcaggagcaggggaaatctcttgccgaaagttttaactatatatctacctctttgactaacattcagggtgatattaaaaagaacctggataacacagcggatcaggtcaattccgttctcaatcagctgaatgaccttaacaatcaaatagcggcagttgagccgagcggtatgctccctaatgatttgtatgaccaaagagacagattgattgatcaattatcttctatggcaaacattaaagtttcatataataagtcgggcggacatgccttggcgactgctgagggcacggttaacgtcgaattgctgaacggaaacaacaattctctcggtacgctgctcgacggtaacacaaaaacagtttcagaaatgaaaatcaactacgataaggacagcggcctcgtgtcgagtgtgtcagtcggcagcaatacggtcaatgcggatgcatttaccggaaaaggctcactcttaggtcttattgaatcatacggctatatgtcaaatggagaagaaaaaggtctttatcctgaaatgctgacggctcttgacaatatggcgctgtcctttgctgacgcgtttaatgcagttcatgaaaaagggaagacctatacaggcgaacagggtgcagcattttttgatttcagcggtggtgaagcggtgccggcaaaaggtgcggcagcgaaaataaaagtcagtgacaaaatccttgcgtctactgataatatcgcagcgtcgttaaacggagaaaaaagtgacggcacaaacgcgacaaatcttgcagccgtacagaacagcaagctgactattaacggtgaaaccactacaattaatgacttttatgaatcccttatcggaaagctgggcgttaattcacaaaaagcggccaatcttatgaacaactctgaaagcaacaccctttcagccgatgaacggagacaatctgtcagtgcagtgtctttagatgaagaaatgacaaatatgattcagtttcagcacgcttataatgcggctgcgcggatcataacgatgcaggatgaaatattcgataaaattattaacggtatgggcaccggaggaagataggagataagtaaatgagagtaactcaagggatgatcgcaaaaaattctcttcgatttatcggctcaagttatgacaagctcgatcggcttcagcagcaagtgtctacggggaaaaaaatcacgaaagcttctgatgatccggtcgttgcaatgaagggaatgcagtaccgtactcagcttgcgcaggtaaaccagtatcagcggaatgtttcgcaaggctttacatggctggaaaactcggaatcaagcgtaaactcggaaacggatattatgggaaaaatccgggacttgatggttcaggcgaaaagtgattcgaatggtgaaacagaattgaaagcaatcggtacagaaatcggccagctgaaaaagcagctcgtttctgtcgcgaatactcaggtaaacggacgttatctgtttaacggaacaaattcagacgtcccgccgatcactgaaaatgccgacggcacatatacgtacaactatgagaattatacaggtgcttcggatgttaacatcaacatctcgaacggagcagtgttgaaagtgaattctgatccgaactcagctttcggaggcgtcgcacaaaatggagataatgtttttgaatttcttaactccttagaagcttctttaagcaaaggcacgctgtccgaagcagattcagatcaaattctgtcagatattgacggttttactgataaaatgaatgctgaaaaatccaatatcggcgcacgcacaaaccggttggaactcattcagacaagattggaatcacaagcggcaaccgctgaaaaagtattgtccgataatgaagatgtagaaatggaagatgtaattgttgattatttatctcaacagacggttcatagagcagcgctgtcagtgaatgcgaacatcattcagccgtcactgattgacttcctgaaataatataactgatcgtcttcaatatataaaaaaagcgactcacaacagggagatcgctttttttactaaaatactataaacaggagggatctctgtgcagatgccgagattgattattgacagtgtgcctgctaaaatcggtataacctttcaaaaggaagaaatcgagatggaacagccgcccgctgacttggaaatcgagcagccgccggcagagctgaacattgaaagcacgccggccaaactgacgattgaccagacgagggcgtgggagaacttgaatctcaaatcatttgaaaagctgaacgctgaagccgcccagaaaggtgcggaagcctgcagcgagtttatcgcaaaaacagtcagggaagggaaggaaatggcggctatcgaaaagaaaacgggcaatgtgatggcccggcaggcagcagatgtcagaccgcccgatccattcggcgaattcagcgactttctgcctgcgcagtttctcgtcgacattgactgcattccttcaaagcttacgattgatattgaagcccgcaaaccttcaattgaagcagccgtcaataaacctgtatggaattatacgccggggaaagttcagattgatatgatgcaagaccctaaggtgacgatttcggttgacgatggcaacgcagaataaaagatgaaagtggtaaaggattgtgaagcatgataattaaaacaaaatatcacggagaaatcagaatagacgaagggcagattatctcatttgaaaacggcctgccgggatttaatgacgagactcaatttgttgttcttcctttgtcggaagattcaccgtttttggcgctgcagtctgtcaaacaggagcacatcgcctttattgtcgccagtccgtttattttctttaaagggtacgaatttgacattgaccatgcgacgcttgaacttttgcatattgaagatatagaggacgtcgaagtgatggcgattttaacgctggaagagccttttgaaaacacgaccgccaatttaaaagcgccgattatcgtcaataaaaaggaaatgaaggcgaaacaaatcattttacatgatgcttcctatgaaacaaaacatctgataggaggaggatcatgctagttctctcaagaaaagtgaatgagtccattcagatcgggccggatattgaaataaaggtgatcgccatcgaaggagaacaagtgaagctgggaattgaagcgcctcagcacgtagatattcacaggaaagaaatctacttgtcgatcctggaagagaacaacagagctgtatcttttaatactgatttattacttaacctatcctcacaaaaaaagtgaggatttttttattttcaatataaacaatagaaacggccatccgatatatatagtgtagccaatgagaggaaaaattttcttcagaatgacgctgcgcaaatgcacaaggacgtgcgaaaaacaattcagggaggaaatacaaaatgagaatcaaccacaatatcgcggctcttaacacaagccgtcagctgaatgcaggttcaaacgctgcttctaaaaacatggaaaaattatcttcaggtcttcgcatcaaccgcgctggtgatgacgctgcgggtcttgcgatctctgaaaaaatgcgttctcaaatccgcggtttagacatggcgtctaaaaacgctcaagacggaatctctcttatccaaacatctgagggtgcattgaacgaaactcacagcattcttcagcgtatgagcgagcttgctacacaagcggcgaacgatacaaacactgattctgaccgttctgagcttcaaaaagagatggaccaattagcgtctgaagtaacaagaatctctactgacactgagttcaacacgaagaaacttcttgacggaactgcgcaaaaccttacgttccaaatcggagctaacgaaggccaaacaatgagcctgtctatcaataaaatggactctgaaagcctgaaagttggtacgacttacacagcaaatgatgacggttctaagcttgtaactgcagatggaaaagaagcaacccttgtcactgacggttctaaagggccgaatggctactatgatgatgctgataaattagtttatcaagctgacagtgcattagctaaagatacaaaagtaacaaaaggtatcgacatctcatcttcagctaaagctgcgtcttcagctcttacaacaatcaaaacagctatcgacacagtttcaagcgagcgcgctaaacttggtgcggttcaaaaccgtttagagcacacaatcaacaaccttggtacttcttctgagaacctgacttctgctgaatcacgtatccgtgacgtagacatggcttctgagatgatggagtacacgaaaaacaacatccttactcaggcttctcaagctatgcttgcgcaagctaaccaacagcctcagcaagttcttcaattgctcaaaggttaatgacggaaagatcctggttctccagggtcttttttttatttcttcagctatctcccccttcagcaagccaaagaaccctattgacaaaatgaaacattatattttgcagttaaattattgaaaaccttttaatatgaccgatataagaataagatcatacatttatggagctgtgatatgataaacagtcggaaactcactgttgtcatagagccgtctacgactaaacgctgaaaaggagagggtacatatggtcacaagaatcacaggccttaattccggtcttgatgtagattctctggtgaaaaaactaatggatgccgaaaagcagccgcttaataaattaaaccagcaaaagcagacgcttgaatggaagcgcgatgcttatcgggaagtgaatacccagattgccgacatgtattctacgacatttaataatatgctgatgtccacaaactggaataaaaaaacagtaacaagttcggattccagtgtcagcgcggtggctgtcagtgctgaacagaatatttcaacgagcatgtctgtacagcagctggccacaccgacgacttataaatcatcaggggccatcaatttcacttcaggtcagagccaaacattgaaattcaatgtcacaaatccgggtgaaacgaagccgactgaggtaaacgtcacgatcgccgcaaccgatacgattgacgatgtcatttccaaactgaacagctcaggccttggggtgacggctttaaaagagaaaatttccaacggcacggattatgtggatacgattgcgttcacttccaataaaacgggggaaggatttaccctttcagcaggtgatgacgcaaccaaaagctttctgaaagatcagctcggttttgccgttgatgatgcaacaaatgaactgacggccaatgccgaagggaaaaacgcgaagtttacgttcaacgggcttgaaatgacaaaaacgtccaataactttacgatcaacggcatcaaatacacgctgaacagcgtgacggacagcaataaaacggttacgattaacagcacgactgatacggacggcatttttgacaacattaaagatttcgttgataaatacaatacgttaattaaaagtgtaaacgagaaggcgtcggaatcaaaataccgtgattataagccgctaaccgatgaacaaagagaagcgatgaccgataagcagattgagcagtgggaagcaaaggccaaaagcggtttattacggagcgacagcacgctgcagaacggtttggcggagatgcggcttgatctgtactcaacggttacgattgacgggaaaaaatatcagcttgcagatttcggaattgagacgtctgatagttatacggatcaaggaaagcttgtcattaaagacgaagcgaaactgaaacagaaaattaccgagaatcctgctctcgtggctaaactgtttaatgcagacagccctgatacagcgaaaaccaaaaacccggaggaacaggggattgcccggagattaaaagacacattaaacaaaatgcagattcaaatttcaaaacaggcgggtacggaaagctcggtatcaaccagctttgccatcggaaaaagcctggatgaaatagaaacaaatatttccaatatgaaaacgaagctggatgacatcgagacgagatattataaaaagttcagcgcactggatacggcattggagaaattgaacagccaatcttcatatctcacgtcaatgttaggatcttcaacatcataaccttggaggttttataaaaatggcaataaataatccttttgctgcttatcagcagacatccgtctttacagccgctccggaagagctgacccttatgctttataacggctgcctgcgattcattaagctggccaggcaggcgatgaagcaaaacaaccttgaagccaaaaatgaaaatatcgtaaaggcgcaaaacatcattcaagagctcagcatcacgttaaaccgggagattgagatttctgaacagatgtcatccatttatgattacatccgccgccggctgatcgacgcgaacgtgcagaataacggagaatttttagatgaagcggaaaaactcgttactgaatttcgcgacacgtggaagcaggccatgcagagtgaacggaaaaacagccacggcgcgggcggccttgcctgatgaacagcaatgtcttttctttgtataacgaaacgaagaacatgtacgccgcactgaaggacgccccggaaagcgacggtcttatcagcagcgttacggcatttacggagaaaagggaggagatgcttgcgggcataaagccgcctttttccgaagaagaaaaaacgctgcttcagcaggtggccgcgatggaccgtctgattaccggcgaagtgaaacggattcaggatggtatccgaaatgaaataaaaacgcttaagaaaaaacgaatctaccataatacgtatttcaatccgtatcatcaaacgacaagtgacggccgtttttacgacaaacgcaaataggtgagtgttttgagaagtttgaacgattaccatttggtgtcagcctactaccagcttctttttacgattgatgaggggctttgctacctgttggacacgcaggatgatttttttaagacggagggcgagcggatttacaacgatttgattcaggctttttttcatctcgattcctctcatgcgcttctgctgtctatcattgagtgccgatgcgtggagacggcgatccgctcatttgacgagatctttcaggatttcagcatgttaaatgattatgatttcccgtccgccccttttcaggagtttttaaaaaccatctttctgccgcattataagctatggatggagcagacgcacgactgcatcaaaccgtatgttcttcactagacctgctgcaagcggcaggtcttttgcctgcgtcctccgcatatacttataatcctggcggaagctgccggataaaaccgacaccattcgtcatcgttcaccgaatttacacattattttaacgtttcagcagggatcagaaggggtaaaagagaaatagttacatatccttagataaagggaggcgttctttgatgaactacaatatcagaggagaaaacattgaggttacacctgcgttaaaggatcatgtggagagaaaaatcggcaagctggagcgatatttcgagcagagcgtcaatgccgatgtgaacgtcaacttaaaattctataatgataaggaatctaaagttgaagtcaccattccgatgactgatctggcgcttcgttctgaagtgcataacgaggatatgtacaatgcaattgatctcgcaacaaacaagctggaacgtcaaatccgaaagcacaaaacaaaagtcaaccgaaaattccgcgagcagggtcttccgaaacattatttcgagaacggcagcgctgctgatacgggcgtagcggttcaggacgaaattgaagatgacagcccggaaattgtccgtcaaaagcgttttaatttaaaaccgatggataatgaagaagcgattctccaaatgaatatgctcggacataatttcttcgtattcaccaacgcggagacgaatctcacaaacgtcgtttaccgcagaaatgacggcaaatacggattaattgaaccgactgaataaacccatccagccttccgtgaacgcgcggaaggtttttctctatctttatctgcaaattctttggaaatagcaaaaggtatgttatgataatgagaggtatacatggacagaaaattatcatttattccatgcaaaatctgcatgtgaacatagaggagcgttatagatgcttgggattttaaataaaatgtttgatccgaccaaacgtgcgctgaacaaatacgaaaaaatagcaaatgacattgatgccgtaagaggagattatgaaaatctctctgacgaggcgcttaaacataaaacggcagaatttaaagagcggcttgaaaaaggagaaacgacggatgaccttcttgtcgaagcgtttgccgtcgttcgtgaagcttcccgccgcgtaaccggcatgttcccgtttaaagtgcagctgatggggggcatcgcccttcatgaggggaacatttccgaaatgaaaacaggggaagggaaaacgctgacgtccacgcttcccgtgtatttaaatgcgttgacgggaaaaggcgttcacgtcgtaacggtcaacgaatatctggcgagccgtgatgcccagcaaatgggagagatttttgcgtttctcgggcttacagtcggcctgaacctgaattcgatgtcaaaagacgaaaaacgcgaagcttacgcagccgatatcacgtattcaacgaacaatgaactcggctttgattatttgcgtgacaacatggtgctctataaagaacaaatggtgcagcgcccgcttcattttgccgttattgatgaagtcgattcaattttagtcgatgaagcgagaacgccattgattatttccggacaagctcagaagtccacaaaactgtacgtgcaggcaaatgcgtttgtccgcacactcaagaaagatcaggattatacgtatgacgtcaaaacgaagggcgttcagctgacggaagaaggaatgacgaaggctgaaaaaacgttcggcatcgacaacctgtttgatgtcaaaaacgtggccttgaaccaccatatcaaccaggctttaaaagcccatgcggcgatgcagaaagacgtggattatgttgttgaggacggccaggtcgtcatcgttgattccttcaccggccgtctgatgaaaggacgccgctacagcgaaggtcttcaccaggcaattgaggcgaaagaaggcctggagattcaaaatgaaagcatgacattggcgacgattacgttccaaaactatttccgtatgtacgaaaagctggccggtatgaccggtaccgcaaaaacggaagaggaagaattccgcaatatttataacatgcaggttgtatccatcccgaccaaccagccggtcatccgtgacgaccgtccggacttgatctaccgctcaatggaagggaaattcaaggcggtggcggaggatgtcgcccagcgctacatgaccggacagccggttcttgtcggtacggttgccgttgaaacgtctgaattgatttctaaacttctgaaaaacaaagggattccgcatcaggtgctgaatgccaaaaaccatgagcgcgaagctcagattattgaggaagcgggacaaaaaggcgctgtcacgattgcgaccaacatggcgggacgcggaaccgacattaaactcggcgaaggcgtaaaagagcttggcggccttgcagtcgtcggtacggaacgccacgaatcccgtcggattgacaatcagctccgcggacgttcaggacgtcagggagacccgggcatcacacaattttatctttcaatggaagatgaattgatgcgccgtttcggagctgaacggacgatggcgatgcttgaccggttcggtatggatgactccacgccgattcagagcaaaatggtgtcacgcgccgtggaatcatctcaaaaacgtgtcgaaggaaacaacttcgattcacgtaaacagcttcttcaatatgacgacgtgctccgtcagcagcgcgaagtcatttacaagcagcgttttgaagtcattgactctgaaaacctgcgtgacattgtggaaggcatgatcaagtcttcactggagcgtgcaattgccgcttatacgccgaaagaggagcttccggaagaatggaatcttgacggcctcgtggagcttgtgaatacaacgtatcttgatgaaggcgcgcttgaaaagagtgatatcttcggaaaagaaccggatgaaatgcatgagatgatcatggatcgcatcatgacaaaatataatgaaaaagaagagaatttcggcacagagcagatgcgtgaattcgaaaaagtcatcgtattgcgtgccgtcgattcaaaatggatggatcatattgatgcgatggatcagctgcgtcaagggattcaccttcgcgcctatgcgcagacaaatccgctgcgtgaataccaaatggaaggtttcgctatgtttgagcacatgattgagtccattgaggacgaggttgcgaaattcgtcatgaaggccgagattgaaagcaatctggaacgcgaagaagttgttcagggccaaacgacggctcatcagcctcaggacggcgatgaggccaaacaagcgaaaaaagcgccggtccgcaaagttgtggatatcggacgtaacgcgccttgccattgcggaagcggaaaaaaatataaaaattgctgcggccggacagaatagtctcgactgtatgaagcgaacatgaccgggtctgcgtcttatggcgccccggatcttttaatgaggtgaatggaatggaattatcagaaatcagggcagagctcgaaaatatggcttctcgtttagcggacttcagggggtctctttgacctcgaatcaaaggaagcccgcattgcagaattagatgaaaagatggcggaaccggaattctggaatgaccagcagaaggcccaaaccgtcatcaatgaagcgaacggtctgaaagaatacgtgaactcctatcatcagctgagcgagtctcacgaagagctgcaaatgacacatgatcttttaaaagaagaacctgaccaggaccttcagcaagagcttgaaaaagagctgaagtcattaacgaaggaattgaatgaatttgagcttcagctgctgctcagtgaaccatatgacaaaaacaacgcgattttagaacttcatccgggggccggcggtacggaatctcaggattggggttccatgctgctcagaatgtatacccgctgggcggaaagacgcggtttcaaagttgaaacgcttgattatctcccgggagatgaagcaggtattaagtctgtcacactgctcattaaaggccacaatgcatatggctatttaaaagcggaaaaaggcgtacaccgcctcgtgcggatttctccatttgattcatcaggccgccgccacacgtcattcgtgtcatgtgaagtcatgcctgaattcaatgaagaaatcgacattgatattcgtaccgaagatattaaagttgatacgtaccgggcgagcggtgccggcggacagcacgtcaatacgactgattcagccgttcggatcacccacctgccgacaaatgtagtcgtcacgtgccagacggaacgttcacaaatcaaaaaccgcgaccgggcgatgaaaatgctcaaagcgaagctgtatcagcgcagaattgaagaacagcaggcggagcttgacgaaatccgcggcgaacagaaagaaatcggctggggcagccaaatccgctcgtacgtcttccatccgtactccatggtgaaagatcaccgcaccaatacggaaatggggaacgtgcaggcggttatggacggagatatcgatattttcattgacgcctatttacgttctaaactgtcgtaatccgggaacacacctgcctttggcaaggtgtgtttttttatccgttctctttttccatttttcacaacagcgctttagcaaattaatacggtatttggctgttatttacttctaagccgggaagacttaaaatgctatcgagagaaaatcggagaacggaggattttgcatggatgtgaatcacaataagccgctccgtctgatcaaagattatatatacatcatgatcggcgcggcgattacggggatcgtgtttaacgtatttttgctgccgaaccgtatagcagcggggggagtaagcgggatcagcaccattttagaaacgtttggttttgaaccggcttacgtgcagtggattattaacatccctttgtttatcgccggagtgatcattctcggcgggaagttcggaatgaagacactggtcggttccatcgttctgccgctcgccgtctatttaacaagagatctgcctgccgcgacgacccatgaactgctggcggcgattttcggaggcgtcgggatcggaacgggaatcggcatcgtgtatctcggcaaaggctccacggggggaacggctctggcgggccagatcattcacaaatacacggggctgtcgctgggaacgtgcctcgccatcatggacggattaattgtgctgagcgcgatgctcgttttcggagtggagcagggactgtatgcgatgctcggggtatttatttcaagcaaaacgattgatgtcgtgcaggtcgggttcaaccgctccaaaatggctttaatcattacgcagcatgaagaagccgtcagatcggctgtgtttaaagaaatcgacaggggtgtgacgaagatttccgcagtcggcgggtatacggaacatgaccgtccgatcttaatgtgtgtcgttggccagaccgaattcacaaaactgaaacaaatcgtcaaacagattgatgagtcagcctttgtcattgtcgcagacgcaagcgaggtgctcggcgagggtttcaaacgcgcgtaaacggggttataatagcgaaggggtgcatcttacatatgaaatcaaaatgggcgctgctggcgctggttctgaccatgtccgtcctgctggcggcatgcggcggttccaatgaatcgaaaaaagaaagctctgacagttcaggcgggtcaaaagcatctgcgtcagcaggagaagagctttatcagcaaagctgtatcggctgccacggaaaagacttagaaggcggcggaggtccgaatttacaggaagtcggcgggaagtatgatgaagctaaaattgaaagcatcattaaaaacggacgcggcaatatgccgagccatcttgtaaatgataaggaagccgctgagatcgcaaaatggctgtcacagaaaaaataacagaaaaaccttgcctgttataggggcaaggttttttcacggtctgggaatgaaaagaaactgtaatagtaatatgtctaaatttgacgtataatgaagtgtactgaggaaaaggaactttcagatttttcatctgtttcctggtaaaccggccataaaccgcagtatttttacgaactctatggctgcaagacataattaaaagattaggtgatttcatgatagagatgaaagaagtatataaatcctatccgaacggtgtaaaagcgattaacgggctgtcagtcatgattcatcccggagaatttgtatatgtcgtgggaccgagcggagccggtaaatctacttttattaaaatgatttacagagaagaaaagccgacaaaaggacaaatattgattaatcataaagatctcgcgtctgtaaaagaaaaagagattcctttcgtgcggcgtaaaataggtgttgttttccaagattttaaacttcttccgaaactgacggtatttgaaaacgtcgcgttcgcgcttgaggtgatcggagagcagcagtccgttattaaaaaacgcgtgctcgaagtgctcgatcttgtgcagctgaagcataaagcgcggcagtttcccgaccagctttccggaggagaacagcagcgtgtttccatcgcaagatccatcgtcaacaatcctgacgtcgtgatagctgacgaaccgacgggcaaccttgatccggtaacatcatgggaagtcatgaagacgctggaagagattaataaccgcggaacgaccgtcgtgatggcgacacacaataaagaaatagtaaacaccatgaagaaacgggtcatcgcgatcgaagacggaattattgtgcgtgatgagtcaagaggggagtatggttcttatgattaaaattctcgggcgccatttgcgtgagagttttaaatctctcggaagaaacacatggatgacatttgcatccatcagtgccgttaccgttacattgattttggtcggcgtgtttttagtcattatgctgaatttaaacaacatggctaaaaatgctgaaaaagaagtggaaattaaagtattaatcgatctgacgtccaataagaaaacgcaggatacgctgcagaatgagattaaagacatctcgggaatccaaagcgtagagttttcatctaaagataaagagcttgatcaattggtcaaaagcttcggcgacagcggaaaggccatgaaaatgcaagatcaggaaaacccgctgaacaacgcgtttatcgtcaaaacgacagatccgcatgatacgccgaaagtcgcgaaaaaaattgagaagctggatcatgtgtataaagtgacatacgggaaagaagaagtcagccgtctgtttaagatcgtcggggtgtcacgcaacatcgggattgcgttaatcatcggccttctgttcacggcgatgttcttaatttcaaatacgattaaaatcacgattttcgccagaagaaaagagattgaaatcatgaagcttgtcggcgcgacaaactggtttatccgctggccgttcttcctggaagggctgctgctgggggtattcggttctatcataccgatcgctctcgtgctgagtacgtaccagtcgatggtcgcttgggtggccccgaaagttcagggatcatttgtttcacttctgccgtacagtccgtttgtgttccaagtatcacttgtgctcattctgatcggcgcggttatcggagtatggggaagtctgacttccatccggaaattccttcgtgtataaatacaaaagccagtctgatatagactggctttttttaatggtttcgttactgaatgacgggaagggccggtgatccgggctttaatgtaaagtcataagacgattcgtcacggtacagcgggtccgcataaatggaatccgaatcgtttgccgttcctttttggtacgctgtgaatgaatcatattctctgttcttccaattccaaatgccgtcttttccggcttctttgtgatagacgttatgattaacggtattgccttcgttttttgtataatcatttgcgataaaaatccgtgaaccgcttgccgtcatgatgtttttttcgatcgtgttcccttttgtgccgtactgcagcagcagctggccgccgtcaaggtccttcgtgtcatttcgatacataatgttatgagcgatcaccgaattgatggtgccgccgcgtttcgtgtcatagcctccgattgaaataccggtgtaagcattgccgtacaccttgttatccgtaatccggatatctcgtgcgtatttccctctatgttcggaagtggcttcaatgccgaggtcattgttgtaaacggtgttcttcttaatgtccacatgttctgcgccgtcaacgtaaataccgcccgctgaatattcatctccgtaagcgggatttccgtaagaagagttatggctcaccgtattgttttcaatgacgccgtttcgcgcatagtcgttttgcttggacgttccttcgtatccgatcacgtcaatcccgatattgttattgtcccgaatggtattgccggcaatcttaaatccgtcaacattcccgttcagcacgaccgcttcgcttgcgccgagcgtcagtttttcaaccgtattatttgtgatgctgacatccttcatggcgtctgtgccgtaaaacgcgatgccgtgtgcatttccctcatcagccgtggttttaatgtttcggatatggttgccgtcaatgttgatatgactgcttgatccggtgacgcaaattcccatggcagtcgcatcttctgatgatacggagaggttctcaagcgtaacgccgtgaatggtaatgtactgtttattgcggatttgaattaacggagtttcagaatcgctttttggcgcagatttgccgctgattgagacatgctcattctgatagttccgaaatgtaatcggcttttcggccgtgccgctgtgctttacttcaaacgtttcatcgtacgtcccttcccgaatcaatacggttgttccggcctctgccttttcagccgcatgttttaatgtgcggaacggcttttctttcgttccttcattttggtcgctgcctgcgggagaaacatacaaggcgtccgtctgcgttttttcattggcctctgtttttggccagacaaaggcggtaatgcctgcggccagaaccgccgcggataaaatcgataattttattttcatatcgcattctcctgtatatttaatgaattgcatacaaaatattatacgttacccatatatatgtaacaatctcgcgttttcatttttttgttgccgttacatgaattctttgcaatttacacatactatctccaggttttcgtaaaaggactaagaggaggtaaacgatgaagcagaaaatgatcgcagtgatggcggccgtcagcatcatgtgcggcggagctcatattgccggggcggcacagccgaattcaacagacgcagaaagaagccgggcaatggaaaaaatcgaaaaagcttatgagctgatctcgaacgaatacgtggaaaatgtagataaagaaaagcttcttgaaggagcgatccaggggatgctgtctacattaaacgacccttattccgtttatatggacaagcagacagctaagcagttttccgattctcttgattcttctttcgaagggatcggcgctgaagtcggtatgaaagacaataaaatcattatcgtatcaccgtttaagcaatctccggcggaaaaagcgggactcaagccgaatgatgaaatcatcagcataaacggcgagtcaatgaacgggaaaggtttaaacgaagccgtgctgaaaatcagaggaaaaaaaggatcgaaggtttctattaaaatacagcgtccgggaactgataaacagctgtcattccggattaaaagagcggaaatcccgcttgaaaccgtatttgcttcccgcaaagaatcaggcggtcatcatgtcggctacatcggaatatcgacattttccgagcataccgcccaggacttcgccgcggcgctgaaaaagcttgaaaaacaagggattgacggtctcgtccttgatgtaagagggaatcccggcggctaccttcaaagcgtcgaacaaattttaaagcatttcatcacaaaagacatgccgtatatccaaattgcggagcgtaacggcgataaaaaacaatatttctcaaccttaaaacataagaagccgtatcccgtcaatgtcatcacggataaaggaagcgcctccgcttcagaaattcttgcgggtgcgttaaaagaagcgggacattatgacgttgtcggtgacacttctttcggtaaaggaacggttcagcaggccgtgcctatgggagacgggagcaacattaaattgacgctttacaaatggctgacaccgaaaggcaattggattcacaaaaaaggcattgctccgacaatcgctgtgagccagccggattattttgcggcgggaccgcttcagctgaaacagccgcttcagcctgatatgaacagcgcggatgtcaagcacgctcaaatcctgctgaaaggcctaggcttcgacccgggcagagcagacggctatttcagcaaaacaatgaaaaaagccgttctggcgtttcaagaccggtacaggcttgataaaacagcggtcattgataaaaagacagcggaaaaaatgaatcagctgatgaatgaaaagaaatctgacgaaaaaaatgatttacagctgcaaatggcgttaaaatcattatttgtaaaataaatgaaaaggaggcgtttttttcgtctcctgtttcttttgtcatgccctaaaaatgaactaaaagacatataattatgtcggttttgacaagatattaaaaaaattttcacatttaaacatttataaaggacaaacattacccgatatttatagagaagagagactttatgccgagttaatatgtattcaaaatgaaacttttgaaagttgcctcagtcagttttagttcttacaataaaagaaggttctaatagagaacagttttagtttggcagctgcatttcagtatcgaaagcagaagtgtttgcggcgcttcagcacggcagctgtaatcacccgtgcttatctggataaaaaaatgggggttcacaattgaagagggcaagtattgtgcgtgaaaaaaaatattatgaattagtggaacaactaaaagacagaacaaaagacgtcacattttcatcaacaaaagcactaagtcttcttatgctgttcagcagatacctggtcaattatacaaatgttgaatgtgttcacgatatcaatgaggagtgtgcaaagcattatttcacctacttaatgaaaaaccataaacgtttaggaatcaatctgacggatattaaacggtccatgcttttgatcagcggtgtaatcgaggtggaagtcgaccactatctgaaagatttctctctctcaaatgtgacgttgtggatgacggaagagagatagacgtttgagatattcaagccaatgattatttggtagaatagaattaaaatgtttggcttgaggcggtgaaagcaatgtctgttcaatggggaattgaacttctgaaaagtatcggtctgttttttttgcacccgatgttttggttttttatcatcataagtctcgcctgcggatatttgcggattaaacgtgaacgccatacgtttcatacaaaaatcgcggatatgtatgacgagcttatctttacatacataaaaggacttataccgggtatacttctctccatattattttttggactgggaatttcgattccattcggtcttctcggcataatcgcggccgtgacggctttggcttcgctgacgttccgtatgaattggctgtcatcagcttatattgtcagcgccggcatgttcattgcgtttctccttcagtatacccacacagtgccgtttgcggatcggtttccgcaggcattcggcgtgaattgggcatcggcggccgtgtttatgggccttttgattatcacggagggagcggctgcctgccgttcagcgcatctgaaaacatctccggcgcttgtcgtcagcagcagaggcctgcccattggccgacaattggcgaatcgcgcatggctgcttccgcttttcttattggtgccgggcagcgggcttgagtcacacctttcttggtggcctgtctttaccgtgccgggcggctctttccatttgatctggattccttatatcgccggcttcggacagcgtgtgcaggggtcacttccggaagtcagcatacggataacagcgaaacgtgtcatgattctcggggttatcgtgaccgcattcggggcagcggccctttggtggactccgcttgccggagctgccgcttgtattgcggtgctcggacgcctgtttttatcattaagacagcggctgaacgataacgcggctccgttttatttctctaagcgggatcagggtttaatggtgctcggcatcattccgaatacacccgcggacgatcttgagctgaagatcggtgagattattacgaaagtaaacggcatccccgtgaagcatgtatcggatttttatgaagcacttcaaaaaaaccgcgcatttgtaaaaatggagatcatcggcctgaacggtgagatccggtttgatcagcgcgcgtcctatgaaggcgaacatcatgaattaggtattttattcgtgcaggatgaacacgagcacgaagaaatgacagcattataatgtgatttttcataattattcggaatagtttcaagaactcctaaactagatttcaaaataaaacagctaagaaaattatattttcttagctgttttattttgaaataataaaaaaataaatgaaggagaggtatggcttattggaaaggttattgctaactccaaaacctttagaagatgaatctttagcaggatatatattaagaataactgattataatggttatgttggatagggggagtacattataaaaaagcttttacttaagagattaccgttgatctcacttggagttatagcttatatactgacaaaatacgcgcagaaccatcaggattgggcggagaaatacagtaggtctgtatatccgttattgtcaaaaacagtaggacttgtaccttcttgggtcacattttctgttagtgaatggctcgtcgtgttggttgtgttactatttctattttatatcgtttattatgtgcgcaaggtcatcatgagtaaaggtgcacgtaggatggtagtttatcgtggtgctctaggaatcgttacgatctgtagcgtgatatatttttgttatactattttgggtggaataaactatcacagatattcttttttgtctcataccgaatataaagaagagaactacagcaaggaagaactggttaaattgagtaagtcacttgccgttgaaatggaattggcaagggaaaagttagcggatactgatcttttggctcatgtaccagaggtttttgattattatgcacaacacgcagtgttctcgatgcaaatgttatcaaagaaatatcctgttttggagcattcatattcaacaccaaaaccagtggtgatgtcaaaactaatgtcgcatgcagggatacatggtatttttgtcccttttacttatgaatccaatatcaatgttaatgtgcccgttttcttggtgcctgctactatggcacatgaattggcacatcagagtggtttcatgcatgaggatgaggcaaattttatagcatatctggcatgtaagcagcaggatgatccaatgatactttacagtggtttttttctagcatttgattattctatatctgagctaaagaaagtggatccagatcaggcgtctgatataatgtccagtctgtccaaggcggtgcagcatgatatagaacaaaatgagcagtaccgggataagtatgagggtgttattccaagtatttcaagaaatgtaaatgatgtatatctgaaggcaaataatcagacagacggtttgaatagctatagtgatatggtgaatttgttgctggcagagcagcgagagatagagaagtacaattaaatgtatcttgaatacttataggtttatatagtaatgatagtgggctcaagttgaacataggagtgagtgaaataaataaaataaaagtatttcctattccatatgctggagcgtcggtaaatgcatattatgaatggaaaaaactactgccggatagatatgaattgtgtatatgtgaattggctggaagaggaactcgattcacagagccttgttaccagtctgttggtgaagcaagtgaagatatcgccaaaagaataagtgaacaattagaatatgacgatgaatatgttatatttggacacagcatgggagccttattgacttatgagatatattataaacttaagcaaatgggaactaaggaaccaaggcatctgtttttttctgggcgaaatgctccacatatttttgaaaagagagaagacattgaaaatatgactaatgaaactttcttgacaaaggtggaacaatatgggggattaccagaggagttttatacaaaagagattatggatatgtttcttccgattttgcgagcagattttataattttggacaattataagtttcagcccaaagcagaaaaaataagctgtggaacaagcgttttttatgcggatcatgatttttcgactcatatcaaagaaattcataaatggagcgaagttgttgaagggaacgtgaaatttcataagtttaaaggagaacatttttttttgaatcggtatcctaatgatattgtaaatactattgttaaagatacagagacttattcttgttcatgagagattcctcgtttcgtcaatgttggtgtggtaacttacattgtacaagaggaatctctcttttgcattcattttttggtagaatttagataatcgacagacgtgttattatataaatctaaaaagattttggtttagactttcttgtcccaatcaagttccaaaaataaaaatttagactttcttttctttgtacagtttgaatgtgttttgaaatattatatttaaaataaattttatcagtctgagaatccttcaatgattgttacttaattttgcttaattataaaagtaatattcaataattgttttaggtaggttttagtaaggagaattatgaaaaaaattaagaaaaaacattggaaataataagctttcagttttattaattatgaaaaatcacatataaagagcccggtgccgctaacaacacggcggccgggctttttttacggccggattacgatgtcagcgccgaacttgatcggaactctcagccatttacattcaccttttctcttgtaaatcaaaagattctcatagagcaaacggcattgcggtgacactttgagagagaaaatgaagaaggaaaactagaaaaggttccggaaagcagatgcttacggaacctttttcgtttacgccgaatggctttttttcgtctgaacggtttccccggacttgataccaagcgatacgaacaagccgatcacagaaactccgatcaatatgataaacagaatatgaaacccggagattaaaccgatcagtgctgaagaaataatgcttccgaaataacggaaggtggagaaaatcccggatgcgatgccggacatgcccggttctaccgtcgcaagagaagatacctgcatgctcgtcagccccgcacctgacgcgatgcctccgactataagcgatgccataagaaacggaacggaatgggaataaaccaaaagcaaaaataagagattggctacggccatcagcccgaaggacagaaaaatcattcttcgcgcgccccatttctgatgcagctgagctccgccccagttgctggcggacatgaaaacagaaaagactgacagcgccatgccgctgtgtgacgtattcatgctgaagtggccggtcataaagagcggcataatcaataacacggcgtacatcattaaattgcttaacagaaccgacagattggcgctcgtaaaggtcgtgtttttaaacaggtcaaaatcaataatcggatgtttcgtgcgcagctcccgcctgaaaaatagcggaacaaatacgagaatgagcagtgcgtacacccaatagcccaaagagctttcacttttcgtcagaagaataatagatacaatgcttccggcaagcaaaacggacccgatgatatcaagcggagcgtcagacgtttcttctttatatttaggaaacatcactaatgccgtcaccagtgcgattgcaagaaacggaatgttgacccaaaagatcgaatgccagctgaagctctcaattaaaagagagccgataaacggaccgagagccgctcccagcccggcaccgaggccgaaaaagccgaatactttcggaagccgtttttcagacacgacatggcggatgatggcgatgctgtttggcgtaagcaaagcgccgccggcagcctgaagcgcccggaagaaaatcaataagaaaagacttggcgagagggcgcaccccaatgatgcgatgagaaaaaggccgacgccccataaatacatttttttgtttccgtacatatcaccgagtttgccggcaatgggctgtgtcacggccatcacgattaaatacacggtcactacccatgtgatgctggcaattgattcgctgaatgagcgggaaatggatgaaagggcgactgcgatcatcgtagaattgatgggaacgagtatggctcccagcaaaagcgaaacgatcagcgcccattctttctttgaacccatccttcatcctccttggagccggaaaatgaccggccggtaatgcctttcatgaaaatctcagtgctgtgtttcagcatcgtttcctcagagagagtgatgactcttttccccagctgcagccggtgtataaaataaccgaaaatcatcgtcataaagacgtctgcattagcttcttcactgccggggcttatcatatttttctttgtcagctccttaaagtaaacgattaaatgctttttcacggattgcggatatacgacaatatcctgcaggacgtcttcgaatagttccggttcgcgcaggcagatgcggaacacttcttttttttgttccaattgctgaagaagggtcgcggcgaaatgaagaagatcctcatacagatcgccttccgccttagtgatcatgctttccggaaccggcgtctgctgttcaatcatggctttcattaatccttgtttgtttttaaaattacggaaaatcgttgcttcgcttacttttgctttttctgcgatttcttttgttgtcgctgcgcggtatcctttttggatgatcagattcatcgcggcgtcaataattctcttgttcgtcgttctcaacatgtttcacctcgcgtaaatactggcaggacaagtatacacccgccctgcccgtcaataaagagggaaacctagcatgaagcgcgtttgacaatcgtaatcttgccgtttgtcccgtccaccgtgacgatatctccgtcgttgagcctgtcagtcgcggcacgtgtgccgagaacggccgggagcccgtattccctcgcgatgatcgccgcatgtgacaggatgccgcccgtgtccgtaatgacggcctttgcatcctggaacagactggtccacagcggtgtcgtcattttgcagacaagcacgtctcctgttgaaaaacgggaaaattcacttgcgtcacgaatgactttcacagggccgcttgcgattccgcttgacgccgcaagtccgtaaatttgatgttcagtgtttttttcatcttctgtgatggagccggtaatctgttcagccattttcagctgttccgaagtcggagtcccgagataagcgggggcttcaagcaattgatattgctggaagagctgttttcgttcagcggctttttcctgcatcggaaccggcgacgccagcgctttctcgacttcatcgctgtataagtaccacatatcctcccgatcatcgattacgccttgtttttgaagcagcccgccgattttcagaaggcaaaggcgcgctttggcgtccagcatcgcatcaatataaaaatggtgatcatctttgatgacggatgaagacaatgtccactgataatagcggtcaaacgtctcccggaagccgtcatcttcaattctatccataaagtcggcgtagagctgttttcgtttttctatcgttttatgaaactcactgtcaaaatcgtatccgttccggacatagttctgaatgttggccaaagcgaaataagggttttccgcccaagtttcttcaatgagatcatgacttttcacggatctccagccgtattcctgtaaaaattcaccgacttgttcgagaaagcgttttccctcatttgattgcagaagcgtctgatgcagctcatcggcatgagaaaccgtaaagacgcgccgcagctcagggctgtcttttacttgtccggaaagcagccacagctgtctgtcggtctccaatgacttattcatgacgccagccagcatttcgtacagaagggaggtgttttctttctcaacctgtccgtacatggattccagtatcatgtttaacgcaacctgcggaaagacaatattgaaatgttctgcgtatccttttaaatagaagtcttgcaggtttcggaacgcatcaagggcagtctccggcgtatggtctgtatgcgccagttcgtccagcttttgataaaaaggcagaaaggtttcctgaataatattgtacatgcggtcagccaagacggggaaaagcgcttctaactgttctgcgggcagcttgtcgtccgtcttatgctgtctggaaaaaacacgtccctgatgaagtttgacacgctcgatttcgatgcccattacagggaatgccttcgtgctctctttgaggccgtattccaaagccggcacaatgagtgaggcgaataacgggctgacggggccttctatattggcctccatattgagccaaaaatctttctgatcctggggcgtcataataaattcccgttcttcgtctgccgctttctgatcctgcacgatcgttgtaatcggcctggcctgaagcagatacagcttattttcggcaaatccgaattcgagatccacgggataaccgtacagttcttccgtctttatcgtcagcatggcaagctccttgatgctctcgtcatcaaggcagaagcggtttctcatgtcagcggtcgtctctttttccgtcacgccttcgtctttagaaacgatatacatttcttttaagccgatttctttttcaatctgaaatgtgtctttattgacgataaatgtgtcgggcgtcacgctgccggagacgattgcttctccgagaccgtagctcgcgctgatcatcagttctccgtcatcgtgtgtgacggggtttcggctgaaaatgactcctgaaacctcggaattgataagcccttgcacgacaacgcccattaatggttctgcggtgtcattgttcattttctctttataaccgctgacccgcgccgagaagaaggaagcccagcattctttcacttttccgagaaactcttcttctgttttgatatttaaataggtttcgtactggcccgcgaaagaagccccttcaagatcttcggacgcggaggaggaacgtacggcgacagaggcgtatgattctctcaattcataaaacgacgcggtcagttcctcccgaagctcttttgaaaacgtgccgttcataatggcgcgctccatctgttcctgatctgcttgaagcccgttgtcttccataaaacgtgtcagggcattcgtctgaatgatgaaaccgccgggaacgggcagcccgttttttgtcagtttaatcaggttcattccttttgctcctgcagagcggctcgattctcccgctttttgaaatcgcactgaatacatgcggtatgaccccctttttttcttcatccaagaaaaatgatagtaaacactatcattacattgtaaagagggaggaagaaactgtcaaagatacaaagacctaaaccttctcatcctttcggctgaagaaaggtaattcgattcatctggttaatggttcaatggatttatattcacaatttttttgacagatgattgaagactgctgaaaaagggtattgtgatagcaggggaacgattgtccgattcttcattttttactataatcagatgagatgaagaattcccgaggagggtttttgtgattacaaaagccgtttttgcattatgtttcccttttatgctggtcgtcctttttacgcgcgtcacgtttaaccactatgtggcgatcgctctcacagccgcactgcttttcgcatcctatttaaagggttacaccgaaacgtattttatcgttggattggatgtcgtatcgctggtggccggagggctgtacatggccaaaaaagaagcagacaaaaagaaagacaatgcctgacatggtgaatatgaaatagaatgcctgcttttacgccataaaagcaggttttttatacaaaaattgacttggtaaaaataaaccatcgaactttagttcgtatttttagtgattttgcccgtcattgtgttactatatcaataggaagatttcgtaaagaaacggaggcttttttgtgaaagatcgttttgagttagtctcgaaatatcagccccagggagatcagccgcaagcgattgagaagcttgtcaaaggcatacaggaaggcagaaaacaccagactctcctgggtgcgacagggacgggcaaaacctttaccgtgtccaatctgattaaagaagtgaataaaccgacactggtcattgcccataacaaaacccttgccggacagctgtacagcgagtttaaggagtttttcccgaacaacgctgtcgaatattttgtcagctattacgattactatcagccggaggcgtacgtgcctcaaacggatacttttatagagaaagacgcaagcattaatgatgaaattgataaactgagacactccgcgacatcctctctgtttgaacggagagatgtcattattatcgcgagtgtgtcatgcatatacggtctcggttcgcctgaagaatatcgggaaatggttgtgtcgctcagaccggaaatggagattgagcgaaatgagctgctgagaaagcttgtggatatccagtatgcccgcaatgatatcgactttcagcgcgggacgttccgcgtgcgcggagacgttgtggaaatctttccggcttcccgtgacgaacattgtatcagagtggaatttttcggagatgaaattgagcggatcagagaggtcgacgctttgaccggagaaattctcggcgaccgtgatcatgtcgcgattttcccggcttcccacttcgtcacccgggcggaaaagatggaaaaagcgattctgaatattgaacaggagcttgaggagcgcttgaaagtgatgcacgaaaacggcaagctccttgaagcgcagcggcttgagcagcggacgagatatgatcttgaaatgatgcgggaaatgggtttttgctcagggatcgagaactattcaagacatttgacactccgaccgccgggctctacgccgtatacgctgcttgattattttccggacgattttatgattgtcgttgatgaatcacatgtgacgattccgcaggtgcgcggcatgttcaacggtgaccaggcgagaaaacaggtgcttgtcgatcacgggttccgcctgccgtcagcgcttgacaaccgtccgctccgattcgaggaatttgagaaacacatgcacaatatcgtgtacgtgtcggcgactccgggaccgtatgaaattgagcatacgccggaaatgatcgagcagatcatcagaccgacgggactcctcgatcccctcattgacgtccggccgatcgaaggacagattgatgatctgatcggcgagattcaggcgaggattgaacggaatgaacgcgttctcgtgacgactttaacgaaaaaaatgtcagaggatctgaccgattatctcaaggaaatcggcatcaaggtcaattatctgcattccgagattaagacgcttgaacggattgaaatcatccgtgacctccgcctcggaaaacatgatgtgttaatcggcatcaacctgctgagggaagggcttgatattccggaagtgtcacttgtcgccattctcgatgcggataaagaaggcttcctccgttctgaacgttcgctgattcagacgatcggacgggcggcgcgaaacgcggaaggccgcgtcatcatgtatgccgataaaatcacgaattcgatggaaatcgcgattaatgaaacgaagcgccgccgggaacagcaggagcgctttaacgaaattcacggcattacgccgcaaacgatcaataaggaaatccgcgatgtgatccgcgcgacgcaggccgctgaggataaagaagaatataaaacaaaagccgcgcctaaactggcgaagatgacgaagaaagaacgccagaaagtcgttgagcaaatggagcacgaaatgaaagaagcggccagagcgcttgatttcgagcgggcggcagagcttcgtgatttactgttagagcttaaagcggaaggatgatgaacacatggcaattgaccggatcgaggtgaaaggcgcaagggcgcacaatttaaaaaacattgatgtaacgattccgcgggatcagctcgtcgtcgtgacggggctgtccggatcgggaaaatcatcccttgcctttgacaccatttacgcggaaggacagaggcggtatgttgaatcgctttctgcctatgcgcgccaatttttagggcagatggataagccggacgttgatgcgatcgaagggctttctccggcgatcagcattgaccagaaaacgacaagccgcaatccgcggtcaaccgtcggaacggtaacggagatctatgattatctccggctgctgtacgcgagagtcgggaaaccgcactgcccggagcacggcattgaaattacgtcgcaaacgattgaacagatggttgaccggattcttgaatattcggagcggacgaagcttcaagtgcttgcgccgatcatctcaggcagaaaaggcgcccatgtcaaagtgcttgaccaaatcagaaagcaaggttacgtaagggtgcggattgacggagaaatggccgagctttccgacgatattgaacttgaaaaaaacaaaaagcattccattgaagtagtcattgaccggatcgttgtcaaggaaggcgttgccgcccggctttccgactcgctggaaaccgcgctccgtttaggggaaggccgtgtcatgatagatgtcatcggtcaggaggagctgatgttcagcgagcatcacgcctgtccgctgtgcggtttttctatcggggagcttgaaccccggctgttttcatttaacagtccgttcggcgcctgtccgacttgcgacggtctcggcttgaagctggaagtggaccctgagctcgtcatccccaatcccgagctgtcattaaaggaacacgccatcgcgccgtggacgccgatcagttcacaatattatccgcagttgcttcaggcggtctgccgccattacggcattgatatggagactccggtcaaagacctgccgaagcatcagcttgataaagtgctgtacggcagcggcaatgaacggatctactttaaatacgagaatgatttcggacaagtgcgcgaaaatgaaattgaatttgaaggtgtgctgcgcaatattgagagacggtataaagagacaagctccgattatatccgtgaacagatggagcagtacatgtcacagaaatcgtgcccgacgtgcaaaggctaccggctgaagaaagaagcgcttgccgttttggtcaacgggcgtcatatcggaaccattaccgaactttctgtcggcgacgcgcttgaatttttcaaaaacctgacgctgtctgagaaagatatgcagattgccgatttaattttaagagagattgtggagcggctcagcttcttagataaagtcggtcttgattacctgacgctgagccgggcggcgggcacgctgtcaggcggagaagcccagcgcatcaggcttgcgacgcagatcggctcccgtttgtcaggcgtcctgtatattcttgatgagccgtccatcggccttcaccagcgtgacaatgaccgtctgatcagcgcgctgaaaaacatgagggatctcggcaacacactgattgtcgttgagcatgatgaggatacgatgatggctgccgattatttgatagatatcggtccgggcgccggcattcacggcggccgcgtcatatcggcggggacgccagaagaagtgatgaatgatgcggactctctgaccggacgctatttgtcaggggctcaattcatcccgatgcctccggagagaagaaagcctgacggccggttcattgaaatcaaaggcgcttcagaaaacaacctgaaaaaagcgaacgccaaattcccgctcggcacttttacggcggtgacaggtgtgtccggttccggaaaaagcacgcttgtgaatgaaattctgcataaggcgcttgcgcaaaagcttcataaagccaaagcgaaaccgggaagccataaagaaatcaaaggccttgaccaccttgataaggtgatcgacatcgaccaggcgccgatcggccggacaccgagatcaaatccggcaacttatacgggcgtgtttgatgatatccgcgatgtattcgcgcagacaaatgaagcaaaggtgcgcggctataaaaaaggccggttcagttttaatgtaaaaggcgggcgctgtgaggcctgccgcggcgacggcatcatcaaaattgagatgcatttccttcctgacgtgtacgtcccgtgtgaagtgtgccacggcaaacgttacaaccgggagacgctggaggtcacatacaaaggaaaaagcatttctgacgttctggatatgacggtggaagatgctctgtctttctttgaaaatatcccgaaaatcaaacgcaagcttcaaacgcttgccgatgtcggactcgggtatgtgacgctcggccagccggcgacgacgctgtcaggcggagaagcgcagcgcgtcaagcttgcttccgaattgcataagcgttccacaggccggacgctgtatattctggacgaaccgacgacaggactccacgttgatgatatcgcaaggcttttggttgtgcttcaaagactcgtcgataacggtgataccgttttggtcattgaacacaatctcgacatcattaaaacggcggactacatcgtagacctgggacctgaaggcggagcgggcggcggcacgatcgtagcctccgggacgcctgaagaagttgtcgaagtgaaagaatcatatacgggccgctatctgaaaccggtaatggaacgtgataaaaaacggatgaaaacattgctggctgaaaaagaaacggcagccacataatagatcaataaaaacagcccaaaactcaccggttttgggctgttgtgttacaggcttttttctgttggggaagctgtctgcttaaatgcattaagtcctgcagaatatgggtgctgctgctgtccagcagcacttttatatattggatatcatgggaaatgggaagaggggctgctttgatctgttccaattcagccagcatttcgctgttcattcttttctgttcgcgaattaaatttagaagactctcttccgttacttgggcgttttcgggatctttctccatttgtatgtcctccttgcatacggtcaggctttgttacatattgtaatcggttcggggaaaagattctatagtgaaatctctgaaatcaaaaattacgtataacgaagcatgtccttagcatgaaaatgaaacccgcccattcgtcatacgtatgtataaggaagggtttttacatcacggcacagggagtgtttttattgaaccgaaatcaagcgattatcgcatcaatctgttatttcagcgtgtttctcgcgccgctcattcttccgattgtggcttactttgtcgtcgatgaaaaagagacgaagcggcatgccatgcgcgctctgatttcccatatcattccgtttgcgggattgctgattgtgaccgcgggtgttgtcggcggattgattacggctcagggggagagtatggtgcccgtttttgttatgataacaggagcagctgtttattttctgatcctcatcggaatggtcatttggaatatcgtgcagggaattaaggtgttacgccaggtgtaagaaaagtcgggggaggcgttttgtatgaaacaggagaaagaacggattttaaagcttgtggaagacggcatgctgacggcgcaggaagcactgacgctcattgaaaaactggatcatgaatataaagaaaaagaagagcagatcaccgcattatctgcggaggtccaggaacctgcggaagatttcgaaagcggggcaaaaggaagccaaaagccgtcgctcggggcgaagctgttcgactggattgattctgccgtcaaaaaagtgaaggaagcggatcttgatctgaatttcggccacgcacacgaagtgcagcatatttttcaatttaaagacagtgaattctcggccattgatatgcagattgcaaacggcagcgtcaatatcgtgccgtgggcggatgaagatatcagagcggagtgccaggcgaaagtgtaccgggcggacagtcaggaggcggcgcgcaccgcatttcttcagcacattgagtgtgaagtgaagggcaataagttttttgtccgcacggaaaagaaaacgatgaaaaccaatgtcacgctttatgttccccagaaagagtacgataagataagagtgaagctgtttaacggaccgatcagaggggaacatttacatgtaaaagaattctcggcgaaaaccacaaacggcgttctgtcattctctcatttgacggctgataaagcgtcggcggaaacagctaacggacaaatcaagctggccggacatcaatgcggcgcgattgaagcggaaacgatcaacggcttgattgatttgcgcggatcgagtgaatccattgacgttcaaagctttaacggcaatatcatgcttaccgtgacagcgccgcactgccgctccatctacacgaaaacgacgaccggaaacgtggagatcgctctgcctgatgattcggcggtgaaagcggagctgaaaagcaatctcggctctctcagccatgagctgattgatgcggaaattttaaaggaaaagaatgataccattcaaaaagaactgatgctggcatcaaatcaaggccatgatcagcatctctcgattttctcagaatcgttaacaggagccattaagctcaagcatactcagaggtgattggatgaaaagactttaccgttcagaaaaaaaccgtaaaatcgccggcgtcgtcggcggtttggcggagtacgtcaatatggatgcgtcgcttttgcgcattatcaccgttgtattagcgcttgtcacgagcggaatcgtgccgattgtatatattatctggtgttttgttgtacctttagaaggagatttgaaataaatgatcaaatgggcagtcagcattttagtaaatgctttattattaatcgttatcgcgggatattttgattccgtccatatcagcagtatcggagcggctgtcatcgccagtgtggttctttctgtgttaaatgtgctgatcaaaccgatcatcatcatattgacattgcctgtcacggttgtgaccctcggcctctttctgtttgtcatcaacgccattacgttaatgatgaccgcagccttgatgggagacagctttcagattgacgggttcggcaccgccatttgggcgtctgtcgtgctgtccgttttccacttgctgatccaaaaaggcatattggagccgcttagaaaaaggtaaaaaacgagctgtcccgagagggcagcttttttatgtgtgatttacataagcggcagcctcctgacgcaacataatgtatagggaggtaatgagatgaaacttgtgatgacgctcttttttctgattggtttgctttgtgtgagtccttctgcggatgcggcgcgcaaagaatcggcaatccccgtgaatcagcaggaattcggacagccgcctcattacataccgcttctggagaatcctccccaaatcgaagtaaaggcggaaatgaaaagaaacctgttcatacaggctcatgtacggaatgctgactatcaagcgttttcggcgtttcttttttataaacaaagcaatgagctggggtttaaaatggtgccgatggagcccgcgccaggcgcaatccggctgtttacggcccagatttcaaaacgggatatctggaatggagaattggaatattacctcgttttcaccaacggcagacagcgggcggaatcggagaaaaagcggctgaagctggacggctatcaagccgatttgaatcatattcccgagctgatgattacggagcttgcggttgatacgaaaaatgaagacggcgctgatgcctatgaatttatcgaggtgtataacacgacggacaggcccattcattttaaagactatcacatccgctaccgctatccgaaggaagggccggaatcagacatgatatggaggccgaaagaagataccgtcattccgtcaggcgggacttacgtgttttggctgagacgcgccgcatcagaactgacgatagatgatttcaaccgctattacgggacacgcctgaaggagggaaaacatctcgccgtcatcgaagggacggacggaatgtccaacggccgcccgcgtacggtggtgctgtcggcaaataccggcaaggatatcgcctcggcgcaataccggaaacacgctttccgccggctgacttctttgctgtacaaatatccgctgaacggaacgggagaattgctgaggatctccacgagcgagcataagccgtcaccgggctctgtttttcaggcgcagatcccgcagcagaaaagggtgataaaacccgacaaggaaaaaccggtcatcgaagaccttacagacagaaagcccgtccggcccgctgaaagcattgaattaaaggctgacataaaagacaaaaaccttgtcaaaacagccgcgttttattaccggaccaatgagaaaaaaccattcaaacgaattctggccgaaaaagaccgcaacgacagcttataccatcacattctttattccccggagctgctcggccaggatcagcttgagtattatatcgcagccagtgatggagaaaatgaagcaaaaacgcccgtcaaaatgattgacattgaacagacgagcaaatcacacggactcagaatgaatgttgaatccgaagatacgatatccggcacctatctgctcaaagcgacttccgacgtcagcgccgataagatcaagctgtggattgacggcaagcggcaggagacccggccggcgctggaaaaagaggtctatttcgccttcgatgcccggaaaacgaatctttattttcaaaacaccgtcataatggaaaatgaggtgctgcacatttttgacgatccgtctcaccgctacagaacgcactcggttctccttccggaacgtctgctgcaaaaagggggcaaaacgcagaaagtatccatccgttcgggctcaaaggtttctccgtatgacacgggagagaatcgggatgattttgtcgtgaaacatgcccgtctggtgctttcggacggaacggtgatcaaagacgggaagacggatccggctgagcagctctttatcggtgacggcaggcgggcgaatcagcagaagaccttctcattcagcctgccggatcatttgtttacgtcacggctgctgccgtggaacacggcgaagctttctgaaggctatcaccatatttttgttagcgacggggaggagcagctgagccaatctgtgcgggtggacaatacggggccgaagattgtcccgggtatcaaagaaggcgcggcgctgaaaggtaatgttgagctgaatgcggacatccgtgacaaatggagcaaagtggaagaggtcaaagcgtttttggacggagaaagcattacgctcccccatcacacgtcatcagccgatctcaagcccggaaaacatacccttaccatcattgcggcagaccttgccggaaatgaaacaacgtccgtccgcaccttccatatcaaacgggaggagccgaaccagccggagcttgccgatcaaaaaatcggcgcccacaaagcaaagctgtccgtccgggtaaaagacccgacgaaggatgacatgaatgtatcattttatcgcggcttccgttataccgcgcggaatccgggcagcgtgaaagtgtataaacacgcctcattgacggaaccgccgaggggcataaaagaaaatgaaatgccgtttaccctgccggaaatgaaccgcatctcggcaaatgacggaaaaaccgtatcggcggaaagtatggagcgttttccttatcaccggttcgaagtctccgttgacccgtctatcgacgaaacggatctggccgaggcggtctggaaaggaagctctctgcccagccgaaaggtaaccatgtatatttggaattaccggacaagccgctggcaggaggcggacagcgttcttgccaaagataaaaagccgtttacattaaaagccgccgtttccgcagcggatgtggtgaagaactcaaaaatgaatgtcatcgtgcaggatcaaataccggcgaaaggcaattacacgtttgtctggatgtcggatacacagtattacgcacaagggcacccgcacatttttgacaaaatgacggagtggatcaaagaaaataaggaaaagcacaatattaaatatgtctttcataccggcgatatcgtcgatgattcaatggtgatgaaacagtggaaaaacgccgatcactccatgcggacgcttgacaaggcggggattccgtacggagtgcttgccggcaatcacgacgtcggccataaagacggcacataccgaaccttcggggatttcttcgggagccgccggtttgaacagaacatgcattacggcggatcatataaaaataaccgcgggcattatgacctgctgtcggcaagcgggaacgattttattatgatttatatgggctggggcattgcggaacaagagattgactggatcaatcaagtgctgaaacggtatccggaccgaaccgccatcttatgctttcatgagtacttgcttgtgagcggaaatcgaagcccgatcggggaaacgatctatcgaaaagtcgtcaagccgaatcgcaatgtggcgatggtattaagcggccattaccataacgccatgaaaaaaaccgatgcgcttgacgatgacggagacggaaaaccggaccgcctcgttcaccaaattctgaccgactaccaggacggtccggaaggggggcagggctttatgcgcatgatgcaattcgatcaggccgccaatcaggttcacatgttctcctactcgccgtacacggatgacatcaattactatgacaccgatctgttcgctgataaagacgaattctcagcagaaatggatttacagccgaagaggaaaagggtagcgaccgattattttgaatgcaacgtctatacgaacgaactgctcggtcataaaaaacacgtaaaaagcggaaaaaccgcaaattgggtctgggacggcctgcagcctgattccgtttattactggtacaccgttgttaaggacccgtacaacggcaaaacaatatcaccgttgtggatgttcaaaacgggaaatacgccgtatcgcccggctccggatcagtttgatttcaggcatgcctcaaacccataacgaaaaaaatacagcctgctgatcgctcagaagaaaatctgacggtcagcaggattttttctgtgcgtaaatggcggcgccctgctgtgataagtgcttttgacttttttatgtcccttttctatactaaaatcgattggttttcgtaatatgcaggaggaaacataatgaacagtaaaaccgggacaaaagaaagaattattcaaacctctgcatatctttttcagattcagggataccatgcgactggtttgaatcaaattataaaagagagcggagcacccagagggtctgtgtatcatcactttccaaacggaaaagcagaactcgccattgcggcgatcaaacatacgggaagatgcgttgaaaagcaaatacagaatagtatgtctcaattcgcggaccctatagaagcgattcagcactttattcatgtaacggctgaacagtttaatgatccgcagaatattgagggcgtgccggttggattgctggcgggtgagaccgctctgatcaatgaaacgttaagatgcacatgtgttgaggtgttcaagaagtggacggatgtgtttgcggcaaaatttcttgagcatgggtttgaacaagaggaagcggagaagctcggggtgacaatcaactcgatgattgaaggcgcaatcatgttttcactggctcataaaaacaaagaaccgctgctgctgatttcaaagcaggttccgtatattgtccaaaacagagggtagcattttattactcttttctttataaaaatagatatcagaaccccagcctctccgttttgacagagtcatagagaacattcaccggcttgatttgaaaatggcagatcaaaaaaacatctccaacccgtaacggttggagatgtttcatttcaccctgtccatataatgcacgaatgtgtagcggtcgcctctgtaggcggatttgacgtgctcaaaggcagtgccgtcctgcagataagtggtccgcttgatatagaggacgggggcgccgggctggataccgagcagctcagcttcttcctcggaagcggctcccggttcaagctcttgttttgcccgtgagatcggcatctgattgtacgcttcaatatgctcatacatggatgattgaaaatgggaggcgtccagttttcccgccttgtcaaacgggatgtacgatgcctcaatcgccatcgggatatcatttgccagccggacgcggatgattttatgaagcgttgccggatagccgcatcccaggatagaagataattcttccgtcgcctgaatcagctggtattcggcaagtctgctccccggcttcatgccccggcttctcatatcttccgtaaagcttgtcagcccttgaagcggctgttccatcttcagtttgctgacgaacgttccccggcctttctgcctgtataaaaatccttcattcaccagattggaaagcgcctggcgcaccgtcattcggctgatgccgaattgttcggcgtattcccgctccgacggaagcagcgcatccgcttccagctcgccgtttttgatttgtgtttttaattgttccataatctgaaagtaaatcggaatcggagattgtttatcaatctgcataggtcaaatcctttcaatcgccgcccgcagccttttcatcaatcaagaccgtcacatccggatgcgcgtgcagggcggaggcggggaatgcttcgctgatgcgcccgtccagaagctgcttcaccgcttgggccttgctttttccggatgccatgatcaaaatccgtttgccggacaaaatcgtcccgatccccattgtcagggcttttacagggacttgatcaattgacggaaagtaccgcgcattcgcctgtcttgtctcttcattcagctcaacgacatgggttcgggattcaaatggcgtcccgggttcattaaagccgatatggccgttgtgtccgatgcctaaaagctgtatatccgctccgccgagtgtttgaatcaatcggtcatatcgtccgcattcggcatcaagatcgtctgcccgtccgtcagggagaaagcggcggtcctttcggctatcgatatgtgcaaaaaaatgtgtattcatataataatgatagctgtttttgtcctcgggagaaagcccggcgtattcatcaaggttgatcgtcgtgacatttcggaatgacaagtcttctgagcggtgcatccgcacaagttctttgtatacgccttcaggggtgcctcccgtcgcaaggccgagaacggcatccggcttttgtttcactgtttcagcaataatcgctgcggctttttcacttaattcttcataatgtctgcatgtgataacgttcatgtccaatcagcctcccttgagatatatgcggtgtttccgcggcaaatcgtggccagcacgccgcactgtccgtccgtcagaacaacgtcggcgtcttttccttcggcgatgcttcctttgcggtcgaatatgccgaggcggcgggccgcatttgccgatgtcatatttgctatatccagccatgagcagtttgtaaacctgcgcatgagcgccgcgccttcattcatttttaaaatggaaccggccagcgtcccgtcagagagaagcgccgtgtccccgcgaacggtgactttttgtccgccgaattcgtattctccgtccttaagcccttttgcccgcatggagtctgttatcatgatcaggtttttgcttcctttcgccaaataggcaagcttaacggccaaaggatgggaatgaatgccgtcagtgatcagctccgccgtgatgcggccgcaggcgagcgccgtaccgatgccccccggctcacggtggtgaaaggagctcatggcgttgaagaggtgtgtcatatgcagtgctccggcatccgccgctttttctaaaagatcggctcccgcgtctgtgtgtcccattgacgggatgatgttttggtcttttaaataacggatcaggctgaaatcaggatcttcttccggtgcaagcgtcacgattttaatcagacctccggagagacgctcccatttctgaaagagcccggcatcagcaggagtaatccattgtttcggctgtgctcccgcctttttcggagagacaaacggtccttctaaatgaatgccgatcaactcagcgcctttttggacctgaggtgaggaagacgcccattttttggcgttgacgagcgctttttcaatgttttcgtgctgctgtgtgatcgttgtcgctaaaaaagaggttgttccttcttcgggcagccgggcggacattgtatcaagagctgcaacatcagcatccatcgtatccgcgccgtatccgccgtgaatatgaatatcaatcattccgggaagcgcatacgagcccgcgggcgccttccattccttctcatacgtttcttgcggtcttgttttccccgcgtaagaaatgatgccgtcctttataccgagaaaaccgtttcggatgatttcttcttctgttacgatgtccgcaccgctgattaacaagctttcagccactttaaaacacgcctttctggttagttgttagttttattttactctttttcagactagttatctagaccagttatgccggaattgtataaatctgttttggttcagacggtaaagtgataaaatataactgttcaaagctcggaacatcccagaacaggaggaacatatcttggcaaaggttcggaccaaagacgtaatggagcagttccatttagaattgatcagcggagaagaagggattaaccgcccgattacgatgagtgatttatcacggcccggtattgaaatcgccggctattttacatattacccgagagaacgggtgcagcttttaggaaaaacggagctgtcatttttcgatcagcttcctgaggaggataaaaaacagcggatggaatcgctgtgcaccgatgtgacgccggctatcatactttccagagatatgccgatcccgccggagcttgtagaagcatccgagaaaaacggcgtgcctgtgctcagatcccctctgaaaacaaccagactgtcaagccggctgacgaattttcttgagagccgtctcgcgccgacaaccgccattcacggcgtgcttgtggatatatacggcgtcggtgtgctcataacgggaaaaagcggcgtcggtaaaagtgaaacggcgctggagcttgtcaaacgcggccatcgtcttgtcgcggatgactgcgtcgaaatccggcaggaggatcaggatacgctcgtcgggaatgcgcctgatctgattgagcatctgcttgaaatcaggggtctcggcattataaatgtcatgacgctgttcggagcgggcgccgtcagaagcaataaaagaattacaatcgtcatggaccttgagctttgggagcaagggaagcaatacgaccgtctcggacttgaagaagaaaaaatgaaaatcattgatacggaaattacaaaactgaccattccagtccgccctgggcgaaatctcgccgttattatcgaagttgcggcgatgaacttcagattgaagcggatgggcttaaatgctgccgagcaatttacgaataagctggcggatgtcattgaagacggcgaacaagacgaataggagttggcaataatatgaacgaagcaggaacaccaatcaatccgattgccttgcagctcgggcctttatccgtgcactggtacgggatcattatcggcgcgggtgcgttattagggctttggatggccatgagggagagtgaaaagcgggggctgaaaaaggacatttttattgatcttgttcttttcgccatcccgatcgcaatcatttgcgcacgggcatactatgtgcttttcgagtggagctattactcggaacaccccggggaaatcattaaaacctggaaaggcggcatcgcgattcacggcggattgatcggcgcgatcgcgacgggaatcgtcttttcaaaagtaagaggcatctcattctggaagctggcggatattgccgcgccgagtattctgctcggccaggccatcgggcgctgggggaactttatcaaccaggaggctcacggtgaagcggtcagccggtcatttttggaaagtctgcatcttccggatttcatcattaatcagatgtacatagacggacaatattatcacccgacgtttttgtatgaatcgctgtggagttttgcgggcgtcgtgattctgcttctgctccgccgcgtgaacctgcgcaggggcaatctgtttttgacgtatgtgatctggtattcgatcggcagatactttattgagggaatgcggacggacagcctgatgcttacgagccagcttcggatcgcgcaggtcatttccattgtgctgattgtacttgcgattattttaatgattttcagacgcatgaaggggtatgccgataagcggtatgctgatacggactgacgcctgaaatcggaaaggacataagatgactgataaacgtgtaaccgccattttatttgatctcgacggcacgctgattgacacgaatgaactgattatcgcttcttaccttcatacgcttgatcattattgcccggggcagtttaaaagggaagatgtgcttccatttatcggcccgcctctgtatgaaacgttttcaggcattaatgctgaaaagtgcgatgagatgatctgcatgtacagagcattcaaccatgaaaagcacgatgaactcgtcacggagtacgaaacggtttatgaaacgctggatgaattgaaaaaagcgggctatcagcttggtattgtcaccacaaagctgagggatacagtcaatatgggattgaagctgacaggcatcggggcgtttttcgatactgtcgtcacgcttgatgatgttaagcacccgaagcctgaccccgaacctgtgcggcttgctctcagccggcttgggtgcgatccgtcggaagccataatggtcggtgacaattatcacgatgtcatggcgggaaaaaacgccggcacgaaaacagccggcgtcgcgtggacgattaaaggcgcacagacgctttccgcctatgaacccgattatatgctcgagaaaatgagtgatttattgcacatcaccggagtgaagtaatccgtgagaaaaacagaccgccatccggtttcaggtgcaaattcattgtggcatgtttatcagacggttccctttctgaaggtgatgaaaaatttcatcatcattcagatcgcaaggtatacgccgtttttaagcgtgaaaaactggctgtaccgaacctttttgaaaatgaatgtcggaaaacagacgtcattcgcgctgatggtgatgccggatatcatgtttcccgaaaaaatcactgtcggaaaaaacagcatcatcggctacaatacgacgattttggctcatgaatatttaatacatgagtaccggaccggttttgtcacaatcggtgacgaggtgatgatcggggcaaacacaactattctgcccggcgtcaccatcgggagcggagccgttgtatcagccggcacgctggtgcacaaagatgtcccggccggggcgtttgtcggaggaaatccgatgcaggtgatctatacggacgaagaaatgaaaaaacgaatggaaaaccccgctgattaacgtcagcggggtttttttatgacttgatcacaatggcctggctgcccatctgcttccaggctttttcaaagtcagatcggtttgtttttctgtttttatagccgtaaggatcattaacgtatacataatcgtgatcataaccggtaacggctacgctatgcatgctgaacgtaatgtcgatttttccgttcggcgtattccaagtctgcatattatcaaccggcttaaaggatgtggtggtaatcacccagaccggccgccctttttcaagctggcggtacactgaagaaatgtcttttcccgtcagatcgtatactttgtttcccgcatattctttggcgagtttatcaatcggctcatgataaacgcctaaacccgggccgttttccatatctccggcaaatccttcattcggatctcccttcagcccgctgctgtatgtgagcggaactttattgattttatccgccaatgtattttttgatacatgatatccggcattgttcaaaatcatagcaaggcttgtcacctcacagccattgtacagtctgggagaatccatctgtctgtacagaacgacattcagcggtgacgcgctcccttttaacggtgttttctcatcaggctcgtcggactgctgattaaaaaaattcaaatgaatatcgtttgtatagatgttatacccgagatagacaaggatggctgtcagaatcaccacacataatgttccaagcgtcttcattattactctcccttgtttctgatgaagctattctatgtattatagcacttctgctcaatatgattcgatcgttccgatatgtttacaggtttgttcattctttagccatgtttatggaaaagaataggcggacattgggcgttgcaattcattcttttatctgctaacatattatcatattagcgaactaaaggattcggaattttccttcagacaaagcggaggtgtaaaaggcaaatgtttatgtttgagaaaccgcatggcatgagagatacgctgcccggtttatacgaagccaagaaaaaagtccgttccacactgacggatttaattgataaatggggttatcagtttatggagacgccgacccttgaattttatgaaacagtaggcgtccagtcagccattgaagaacagcagctgtttaagcttctcgatcaggacgggaaaacgcttgtgcttcggcctgatatgaccggaccgattgccagggtggcggcgtctaagctgcacaaacacaatcatccgctcagagcggggtacgcggcaagcgtctatcgcgctcaagagcgggaaggcggacgtccggccgaattcgaacaggtcggcgcggagctgatcggcgacggatcaacaagcgcggacgccgaggtgattgcgctggcggtcggcgctttgaaaaacgcgggattgcaccggtttaaaatcgcgatcggccatgccggactcgctgatgagctgtttgtcgaggttctgggcaatgctgagcgggcggatgttctgcgacgctttctctttgagaagaattacgtgggatacagggaacatgtcaaatcgcttccgctttcttcaatagataaaagccggctgctcacacttctggaattgcgaggcgggaaagagatctgcgccaaagcggaggagatcatcggcatctccggacaaagcttgattcaggagctggaagacctgtgggacattcttgaggattacggatgtgccgagcatattcgccttgatctgaatatggtaagccatatgagttattacacgggaattttattcgaagtgtatgcggcaaatgtcggttttgtcatcggaagcggcggacgctataacaatcttctcggccatttcggcagtcccgctcccgccacgggtttcgggctccgtatcgacaggctgattgaagcgctcggcatccaggaagaaactagtgaagcggacgccgtgattttcagcaaggagcagcgggcgcaggccattttattcgcggaggaagaaagggcgagaggcagaaaagtcgtcctgcaggatctggcgggcattgaaaatatcgatcatatgacaaaatcatttgcaaacgtcacatactttatcggtgccagaaaggaagagcagaatggataaggtactcacaatggcaatgccaaaaggacggatattcgaagaagcggccgggttgctgcggcaggccgggtacaggctgcccgaggagtttgaagaatcgagaaagctgatcattgacgttcctgaagaaaatctccgctttattctggcaaagccgatggatgtgacgacttatgtcgagcatggcgtcgctgatgccggtattgccggaaaggatgtcatgcttgaggaagagcgtgacgtgtatgaggtgctcgatctgaaaatcagcaaatgccatctcgccgttgcggggcttccaggagcggattggaacggagtcgccccgaggattgcgacgaaatatccgaatgttgcgtcaagttatttcagagagcagggcgagcaggtggaaatcattaagctgaacggttcgattgaattggcgcctttaatcgggcttgctgacagaatcgtagatatcgtatcaaccgggcggacattaaaagaaaacggtctcgttgaatcagaacatatttgtgacatcacatcgcgttttatcgtcaatccggtcagctaccgcatgaaggatgatgtaatcgacgaaatggcggccaggctggccagggttgtggaaggagaaacggcacaatgaaaataacggcagtaaaaagaagcgagcggttctcactgaagcgttccatcgacagcggaaccgaagagcagcggaaaaccgtcagggggattattgaagacgtcagacaaaacggtgacaaagccgttttggcctatacaaaaacatttgacggcatcagcctgaaccaaatggccgtgagtgcagaggaagtcaccgaggcgtaccgtctgcttgatgatcagctgctggaagtgatcagacaggcgattgccaatattaaagaatatcacgaacgccagctgcaatcctcgtggttttaccatcgcaaagacggctcgatgctcgggcagaaaataacggcgctcgattccgcgggcgtatacgtgccgggcgggacggcggcttatccgtcttccgttttaatgaatgtcatccccgctctcgctgcgggagtggaacggatcgttctcgtcagtcctccgggaaaagacggccgcctttcgccgggcgttctggcggcggcgtctgagctcggcataaaggaaatttacaaagcgggaggcgcgcaggcgattgccgcgctcgcttacggaaccgaaacgatacagcctgttgataagatcacgggccccggcaatatatttgtagcactcgcgaagcgcgaagtcttcggcgttgtggatattgacatgattgccgggcccagtgaaatcgtggtccttgcagacgatacggcggtgcccaaagaagtcgccgctgacctgctttcacaggccgaacacgatacgctcagctcaagcgtgcttgtcaccgactcacggaagcttgccgaagccgtatcagatgaggtgaataaacagcttcagacgctgccgcgtaaagaaatcgccgaagcgtcgatcaaggatcacggccgcatttatatcgcggaatcgatggaagatgcagtggacacggtgaatgcgctggcgcccgagcatttagaaatcatgacgcattcgccggaggctttgcttggaagcatcagacacgcgggggcgattttcttagggcgatacagcgctgaaccggtcggcgattattttgccggaccgaatcacgttttgccgacaaacggaacggcgcggttttcaagcccgttgaatgtaacagattttcaaaagaaatcgagcatcatctcatacagccggaaggcatttgaaacgcacgcggacagcatttccgccttcgcgagactggaagggcttgaagcgcacgcaagatcgattgaagcgagaaacggaggaatgaccgatgagaaaagcggaacgcgccagaacaacaaatgagaccgatattaagctggctttcgaaatagacggagaaggaaaagccgacatcagcacggatgtgccgtttatgactcatatgcttgatttgttcacaaagcacgggcaattcaatttaactgttgacgcaaaaggcgatacggagatagatgatcaccacacgactgaagatatcggcatctgcttagggcaggcttttttggaggcgctcggtgataaaaaagggatcaaacggtacggatcagcgctagtaccgatggacgaagcgctcgcccaagtcgccgtagacctgagcaaccggccgcaccttgagatgcgcggtgcatttccgcaagcgaaagtcggaacgtttgataccgagctggtacacgaattcctatggaaactggcgctggaagcgagaatgaatctgcacgtcatcgttcattacggaacgaatacccatcatatgatagaagccgtgtttaaggcgcttggcagagcgcttgatgaagcgtcatccattgatccgcgcgtcaagggtgtgccgtctacgaaaggaatgctgtaaatgatcggtgtaattgattacggtatgggcaatttattcagcgtgtcgaaggcgctggaacgcgtcggtgtcccgtatgtcgtatcagaccggccggaagagcttgaaaaagcggatgcttttattctccccggtgtcggatcattcagtgacgccatggacaatttacgcagcgcgaagcttgatcaattcatacaccgtatggttgacgagggtaagctgctcctcggcatctgcctcggcatgcagctcattttcgaagaaagcaccgaaaacggctctgcaaaaggactcggtttattagccggaaaagctgtgagactcaaagacagagatgccgaaggaaacaagctgaaggtgccgcatatgggctggaaccggctgacgtttcaccaaacgtctcctttgctttcggaagcggaagaaggcttcgtttactttgtccattcctattatatagacgggatggaagacggcgatcttctggcaagcgctgagtacggcgttcgtgttccggcggtcgtcgggaaacgcaatgtcttcggtgcacagtttcacccggaaaaaagcggtacggccggaatggcgatcttaacgcaatttacaaaaatggcagcggaacagaaggtgaagaaatgaacgcttttacattatatccggcaatcgatatgagaaacggcaaatgcgtccgcctcatccaaggcgattacggcaaggaaacgatatacggtgactctcctttagacatggcggcgcaatttgcacaagaaggcgccgaatggattcatctcgtggatcttgacggcgcgaaagcaggcaggaaagtaaacgacaggcatgttcttgacattgcgcggcagcttgatgtcaaagtcgagatcggcggcgggatccgttctgaagcggatgtgtacggttatttatcacaagatgttgatcgcgttattctcggcagctcggctgtttccgatccggcatttgtgaagagcatgctgaaacaatacggcggcaaaatcgcgatcggtcttgatgcaaggaacggatatgtctcgacggaaggctggctggaaacatcctcggtaagggcggccgatctgggccgtgaattggcgaaggaaggagcggaaaccttcattttcacggatattgcaactgacggcatgctgtcaggaccgaacatcgaaagcaccgttcagctcgcaaaagcaacgggaaaaaccgtcatcgcttcaggcggagtcagctcagtcgccgacctcaaagcactggcccgcttcaaagacgccggcgtatcgggagcgattatcggaaaagcgctgtatacaaaacaatttacattggctgaagcgctcagcggggtgaaggacgcatgatcacgaaacgaatcattccgtgtctcgatgtgaaagaaggccgcgtcgttaaaggcattcaatttctcgggctgaaagatgcgggcgatcctgtcgagctggccgaagcttacgacagggagggcgctgacgaacttgtttttctcgacatttccgcctctcacgaaggccgcaagacgatgacagacgtcgtagaacaagttgcggcaaaactggcgattccgtttacagtcggcggcggaatcaatcaattaagcgatatgaaacgaatgcttcgcgccggcgctgataaagtatccgttaatacagcggccgtcctccgccccgagctgattacggaaggagcggattttttcggctcgcaatgcatcgtcgcggcgattgacgcaaagtatgatgaagattcggattgctataaagtgtacacacacggcggcagaaagaaaaccgagtgggaagtcacggcctgggcaaaagaagccgtcagccggggagcgggtgaaatcctgctgacaagcatggacgcagacggtgagaaaacaggctttaatcatacgctcacacagcttgtctcacgtgcagtcccggtgcccgtcattgcgtcagggggagccggcagcgcgcgccatatgcttgaagccttcacgatcggtgaagcggacgccgcgcttgcagcttccattttccattacaaagagacatctataaaagaagtgaaagattatatgaagaaacacggggtgaatgtgagatgaaacgggcagatgaactgcggtttgacgaggccggactgattcccgccatcgtgcaggatgcggcaagcaaagaagtactgacactggcttatatgaatcgtgaatcctacgaaaaaacgatagaaacgaaagaaacctggttttacagccgttcacgcggggagctgtggcataaaggagcgacgtcggggaatacccaaaaggtgaaagccatccgctatgattgcgatcaagatgctcttgtcgtgcttgcggagccttcaggacccgcatgccataagggaagctacagctgcttttctccggaaaaagcggatgcgcaggatcgtttcggcatcttaaatgaactggaaagcgtaatcgccaaacggcaggcggagatgcctgacggagcctacacaacgtatctgtttcgggaaggcgtcgataaaatcctcaaaaaagtcggcgaagaagccgcagaggttattatcgccgcgaaaaaccgggaccatgaagaattaaaatgggaagcggcggatttgctgtatcatttgctcgttcttctgcgtgagcagtcgcttcctttggacgacgtgcttgacgtccttgcgaaacgccattcagcatctgagtaaaacaaacctcacggagagatccgtgaggtttttaatctgtcaaacttaaacattcaattaaatattccttatttccgcaaccggaggcagatgaatttgataatattgactaatagagtttattttggtttttatcaaaaatatactttttgttcatattccgttcatgcacatccgttatagtataaacagtgatataggaggaaaacttatgccgaataaacaaccaaaacctaaagggaaattcagctcattcttttcattagtcaaaaaaacaaaaccatcatacggtatgctggccttcgcgctgtctctcagtattgtgacaacgctcgtcagcctgctgattccgctgttgacaaagcagctcgttgacggcttttccatgtcgtcgctgtcaggcgtgcaaatcggaatcatcgcagccgtgtttatcgtacaggccgcattaagcgcctacgccacctacgccctgaactacagcggccagaaaatcatctcgggcctgcgtgatttgttgtggcagaaattaattaaactgcccgtctcttattttgacaaaaacgccacgggagaaacgatcagccgtgtcaccaatgacacaatggtggtaaaagagctgatcacaaacaatatcagcggatttattaccggaatcatctccgttatcgggtcactgacgatcttatttttcatgaactggaagctcacattgctcgtgctgatcgtcgtgccgctggctgcggtgattttagtgccgatcggccggaaaatgtttaaaatttctcgggaaacacaggatgaaacggcgagattcaccggattattaaaccacatcctcccggaaatcaggcttgtaaaagcgtcaaacgctgaagaagcggaatacggacgcggaaaagcaggcatcatggcactctttaaactcgggctgcgtgaagcgaaggtgcagtcgctcgtaggtccgcttattacacttgtattaatggcggcgctggtcgctgtcatcgggtacggcgggatgcaggtgtcatccggtgaattgacagccggcgcactcgttgcctttatcctgtatttgtttcagatcattatgccgatgggccagatcacttcatttttcacacagcttcaaaaatccgtcggcgcaacggaacggatgattcatattcttgcagaaaaagaagaagatatccaaaccggaaaagccattgaaaacgcagatcagccgattaagcttgaacaagtctcattcggctacaaaacagatcaaaccatcttaaaagacattacggctacgattgaagccggcaaagtcaccgcgatcgtcggaccgagcggcggcggaaaaacaacgttatttaagctgcttgaacgattctacaatccgactgcgggcagcatcctgctcggaaatgaaccgattgatgcgtattcccttgagtcatggcgggagcatatcggctacgtgtcgcaagaaagcccgttaatgtcaggcaccatccgcgacaatatctgctacggattaaaacgcgaggtgaccgatgaggaactgaggcaagcggctgacatggcctacgctctgcaatttattgaagacttaccgaagaaatttgaaacagaggtcggtgagcggggaattatgctgtcaggcggacagcgccagcgcatcgccattgccagagcgctccttcgcaacccgagcattctgatgcttgatgaagcgacatcaagtctggacagccaatctgaaaaatgggtgcagcaggcgctggaagttctaatgaaaggccgcaccaccatcgtgattgcccaccgtttatccacggttgtggatgcagatcagcttctctttgtcgaacagggtgaaatcaccggacggggcacacaccatgaattaatggcatcccattcgctgtaccgcgattttgcggagcagcagctgaagctgaatgccgacttagaaaacaaagctgtgtaaagcaagactttatgaatcaaaagcagctgaaaaagctgctttttattttgcagccggagtcctgttcttacgggtgtacggtcggtaacgatgaagagccaagccataagcgtgtatgccggtacaggagacaatgaaaaaattcggtttatagacatcatgtcgattcatgaaaagaaaaaagcagaaggagggattttcatggctgtcatattggttgcggatgatgaccgccatatccgtgagcttgtccgccttatgatggagcagagcggttttgacgtcgcagaagcggaagacggggaagcggcggtgcggctgatcgaatcagcacctatagatctcatcatactggatgtgatgatgccgaaaatggacgggtttgaagtcagtgaagccgtccgcagctttacggacattccgattttgatgctgacggcaaaaggcgaaacgctggacaaagttcaaggttttacttccggagcggatgattatctcgtcaaaccgtttgagccgcttgagctggaagcaagggtcaaagcattgctgaaacggtaccggatcaccgctgaaaaactgctgaccatcggaacggtcacattagataagcaatcccgcactgtaacgcgcggcggcggagcgggattgacattgccccggcgggaatttgagcttttatttaagctcgccggttatccgaataagacgttttcaagagaacaattaatagaagatatttggggctttgattatgaaggtgacgagcgtaccgttgatgtgcatattaaaaggctgagagaacggtttccggaaaaagactatccgtttgccatccatacggtgcgggggctcgggtatcggtttgtggtgacaggatgaaacggatcttcagaacggctggaaaaatcatcatccttctcaccgtcaccgcattcttatggctggcggctcacctgattgttcagggattcggtctcatatggccgattttgcttgtgccgtacgccgagcagattctgacgctttggcttgttttcggcctgctgttcgtaacaatgtttattttttcaaagtcagcacgtgaaaggcatcatgcgatctgggattcgctgaccgccacgatcaagcaaatgtcgagcggcaacttcacagcggccgcttcccggaaaatggagaagattgagcggaaccatcccgtgacgaaattggctgatgaactgtcgacactcgccgcggaactgagtgaaatggaaaaactgaaacaagaatttatttcgaacgtttcccatgaaatccaaaccccgctcacttcattaaagggctacgcgcatcttctgaaaaaaccggatttatcatatgaggagcgggggcgctacttacacatcatcgaaacagaaacagaacgattatcaaaaatcagtgaaaatctgctgaagctcactgcgctcgaacgccaaaccgaaccgatacaaaaaaaaccgttccgcattgacaaacagctgcggcgcaccatattgacctgtgagcctgaatggtccgccaaacagattgagtttctcattgatttacaggagtcgtatgtgtacggagatgaagcgctgctcagccaagtatggatgaatctgattcacaatgccgtaaaatttaccggtgaaggcggccgcatttccgttaaaattgcagatctgccgggagcggcggctgtcgaaatcgccgacgacggaatcggaatggagcctgaacaggcggagcgtgtatttgaacggttttataaagcggacaaggcgagaaacgaaggaggaagcgggctcggcctgtccatcgcccaaaaaatcgcagagctgcacggcggttcgatagaggttgagagcaagcggggcgaaggaacccttttccgcgtcattcttccagccgagcctcgtgaaaaaaacagctaaaatctggtcgaaccagccagtaaaaaacgaagtcgatcctgtcttttgaactattgaggtgaaaccgttttatggtatactactgacggtaatacgtataaaacggaggatatttgtgggaaaacacacttctgaacagaaaaagcacgcgcaaattgtccagctgcttcaggatggacaatatttttttcataaaggcttaaaagcatataaagagcggaatttaaagcgggccagcaaactgattcagcgggccgtccacctcgagccgaatgattccgaaatgctgtcccggctggccgtcatttattctgaaatgggccactaccagcagtcaaatgagctgttcgactttattttggtgaacctgaaagaagaaatgcccgagtgtcattactttaaagcgaataatttcgcgcatttggggctctttcaggaagcatacaaagaagcggcggcttattcagatgccgatccggacggtgaattcagcgaagaaattgaaaatctgatggagctattggatttcggcgaagcgggtgaaaacgaatcgctctatgaccaggatgaactgctgatcaggcaggatcgggcaaaaacgcttcttgagagcggccagcttcatgaagcggttgtcatgcttgaagagattacggccgattaccccgagctttggtctgcatacaacaacctggcgctcgcttacttttactcaggcaatgtcacaaaagcgaaacaaacggtattcgaagtgcttgagaaaaatgaaggcaatctccatgccctgtgcaacctccttgtattctgctattacgagagggaagatgaaaaagtcggagaattgagcggaaaactcgccaatgtgtatccgattttattcgaacagcgctataagctgggggcgacgcttgcgcttgtcggcagacatgatctcggttataaatggctccgttctctttacaaaagcgggtttgaaggcgacgaaacgttttattactggcttgccgcttcagcctacgggacaggccgcacagaatttgcggaaaccatttggaaaaaggccgaagccgaatttcccgaatcagatcggcccgcgccttgggcggagcggcaggaaccgctgcctgcttcacttgaacagcggcttgccgcctattatatcagcagcgctgaaggagagcggaaccagcttgaaaaagttctgacggcaaaacgcgccgtttcaccgtttgaacaagatttcgtcagactgctgctttccggtgaaaaaggcgtttcaggcgtctccggtgatgcgctgttcacgtatcggacggtcaagcttctggagaaagcggaagccgacagtttaaaaactgacgtcatgagctgctgggtttttcacgtcattcagcacatccgcgccgccgctgccgtacagaatgagcgggcatgggccgcagccatcgcatatgtatggaaagaagcaaacggcgaaaaaacgacgaaaaaagaaacggccgccgtttacggtataaccccggcaacactttcgaaatacatcagacaaatagatgatatattagaataaaaccgattctttctatataaagagtcggttctttttttatcagaaaggggcaaaacagaactttaccgccgaaaaaagaggtattcatacgtatttttttgcttttcgaatcgaaaccaggccgtaatcaccgtttattttgcaaaatatgagatttgcaatcacattgaaatataactgtaataaaaattgtcgaaacatgatggtataatgagtctcgtacataagagattagtttattttacatgtgctgtataatctataccaatttaaaagatttaaagattcatacataaaaatcatcagcctcacgggtatgtgagggagcgtaactttgatgttcataatagaattccaaatgagaacaggtttaaagtaaaagggaggaaagaaaaagtgaaaaagagtttattaacacttggtttggcttccgtcatcgggacaagcagttttttgatcccgtttacaaaaactgcatcggcggaaacattagacagcaaaaaagcaaaaattgaaagcaagcaatctgaggtggcttcaagccttgaagcaaaagaaagagaattgtctaagcttcaggacaagcaggctaagattgaaaaagaactgaaagacattaacgctaaagcgttggatacaagcaataaaatcgaagataaaaaagctgaaaacgaaaaaacgaaaaagcagatcgctgatttgaaaaaagaaattaaagaaacagaagcgcgtattgaaaaacgcaatgaaatcctgaaaaaacgcgttcgttctttacaggaaaacggcggttctcaaggatacatagatgttcttttaggggcgacaagcttcggagacttcatttcccgtgcgactgcggtatcttctatcgttgatgcggataaagagctgatcaaacagcaggagcaggataaagcgaaactcgaagacgcagaagctgaacttaacgtgaagctgaaaaaagttcaagatgatcttgcgaaactcgagtctatgcaaaaagacctgaacaaacagcttgatcagaaagacaagcttttcgacgaagcgaaaaacggtcagaaaaaagcggcttccgctatctctgatctgaaaaaagaagcatcaaagcttgcaaacgaaaaagctgacactgaaaaagaacagaagcgcattaaagctgagcaggctgcagcggctgccctgatcaaaaaacaggaagaagcgcaaaaagcttctgaagaccaaaaccaaaaagatgacagccagccggcaccggcggttaaaactgtgaaaaaagcggctgtttcaacatcatctgattcatctgacagctcaagcaaaccgaagagcacttcaggcggatcatctcataacagcggcggttcagatgattctgacggcggatctgttatttcaaattcaggcggtattgaaggcgcgatcagcgtaggatcaagccttgtgggtcaatccccgtacaaattcggcggcggacgcactcaatctgatattaacaaccgtatttttgactgctcttcattcgtacgctgggcttatgctaacgcaggcgttaatctcggacctgcaagcggcacaaacacagatacattaatcggaagaggtaaggcagtaagcgcgtctgacatgaaacgcggagacttagtattcttcaacacgtataaaacaaacggccacgtcggcatctacttaggtaacggaacgttcctgaacgataatacatcacacggtgtatccattgattctatgagcaacccttactggaagaaagcattcaacggcaatgtaagacgtgtcgtggaataatgaataagacaagggccttctatcccggaaggctctttctttatttgtatacccgctcaggagctgcctaatcacggtttttcagaaaaatgagcaaaaaaatagcgaattgccttcagatttaataggatatgggtaaggaatacgattgatggggattcttagtcatatagggtgcgccccatttcgaaaaggagtgaatcatggtgtcagaagaaaaaatttatgatgtgatcattatcggcgcgggtccggcggggatgaccgctgctgtttacacatcacgagcgaacttatccacattaatgatcgaaagaggaattccgggcggccagatggccaacacggaggatgttgaaaactatccgggttttgaaagcattctcggccctgaactttctaataaaatgtttgaacatgcgaaaaaattcggtgcggaatatgcgtacggcgatattaaagaaatcgttgacggcaaagaatataaaacggtcaaagccggttcaaaagaatataaagcgcgtgccatcgtcatttctgccggagcggaatacaaaaagatcggtgttcccggcgaaaaagaactgggcggccgcggcgtatcgtactgcgcggtttgtgacggcgcgttctttaaaaataaagagcttgtcgttgtcggcggcggagactccgccgttgaagaaggcgtctatctgacacgcttcgcttcaaaagtcaccatcgttcacagacgtgacaaattgcgtgcgcaaagcattcttcaggcgcgtgcctttgacaatgagaaaattgacttcaaatggaacaaaaccgtaaaagaaatccatgaggaaaacggaaaagtcggcagacttactcttgtggataccgtgacgggagaagaagaagaattcaaagctgacggcgtctttatttatatcggtatgcttccgctttctaaaccgttcgaaaacttgggcatcacaaatgaagaaggctacattgaaacaaacgctcaaatggaaacaaaagttccaggcattttcgccgcgggagacatccgtgaaaaaacgctccgccagatcgtaacggcgacaggcgacggaagtattgcggctcaaagcgttcagcattatgtggaagagcttgaggaaacgctcaaaaccgttaaataatcactgtaatgttcagtttttgaatcgttactgtgttttaattacgctgtaacacgggtgaaacactgatgtcttaagatgaatgtagtaattgaccccctttttaatgaatacactttggcacggattccagtatccgtgccctttttttgcgattttctgttttctgtcaaataaaagaaaaggatgtcggtgtctctgcattgtgagagacatgccgaaacggtataatgaagagacgatgatttgttgagaaggttaggtgacgtacttgtgcaaagagtgacaaattgtgtgctgcagacagatgatcaggttctccttctccaaaagccgagacggggctggtgggtcgcgcccggcgggaagatggaaagcggcgaatccgtcagagattccgtcatcagagagtacagagaagagacgggcatttatatactaaatccgcagttaaaaggcgtgtttacctttattattaaggaacaggaacaaatcgtgtcagagtggatgatgtttactttcgtcgccgactcgtacacggggcgaaatgtcgctgaatcagaggaaggcgttctgaagtggcatgacgtaaaagatatccacagccttccgatggcccccggagacgggcatatccttgattttatgatcaagggccaagggcttttgcacggcacctttacgtatacgccggacttcgagctgctcagctatcgtttagatccgcagcttatcaaataaaagaaagaccgcaggggggagaaagatgagtatgaatgaaaaccatgatattcagctcgtcatcattacgggaatgtctggagcggggaaaaccgtcgccattcaaagctttgaggatctcggctatttttgcgtcgacaatctgccgccttccttgctgccgaaatttttggagctgatgaaagaatcaagttcaaaaatgagcaaggtcgcgcttgtcatggatctgcggggacgtgaattttttgacaggctgattgaggcgctggatgaaatggcggaaaatccgtggattacaccgcgcattctctttttagacgctaaggattccatccttgtgacgagatacaaagaaacgaggcgttctcacccgctggccgctaccgggcttcctctcgaaggaatcgcgctggaacgccagctgcttgaagaattgaaagggcgctctcagctgatctatgacacatcggatatgaaaccgcgtgatctgcgtgaaaaaatcgtggctcatttcgccacgaaccaaggtgaaacatttacagtgaacgtaatgtcattcgggttcaaatacgggcttccgatagatgccgacctcgtgtttgatgtaaggtttctgccgaatccgttctacattgaaagcatgaggccgcttacggggaaagatgaggaagtgtcatcctatgtgatgaagtggaacgaaacacaaaagtttattgaaaagcttgttgatctgctcggctttatgcttccgtcttataagcgggaaggtaaaagccagcttgtcatcgcgatcggctgtacgggcggccagcaccgctccgtcacgctcgctgaatatttggctgactattttaaaaaagatttctatactcatgtcactcaccgggacattgaaaagagaagccggaaatgaataagaagccgaaaatcgcaatcttcggcggcggaacgggtctgtccgtgctgcttcgggggttaaagcataagcccgttgatattacggcgattgtgacagttgctgatgacggcggaagttcaggccgtctgcgggatgaacttcaaattccgccgccgggtgacatccgtaacgtactggctgctttgtcagatgttgagccgctcgttgaaaatctgtttcagcaccgtttcaacaaaggaagcgacttaaccggacattcgctcggcaatttgattttggcagcgatgacaaatataaccggtgatttctttcacgctgtcaccgaaatgagcaaggtgctgaatgtccgcggcagagtgctgccggctgccaacaccagtgtcgttcttcacgctgaaatggaggacgggcaggtcgtctccggagaatcgacaatcccttcttacggccagcggattaaacgggtgtttcttacgcctgaaaaaattgatccgctcccggaaacgattgacgtcatccgtcaggccgatttaatcattatcggtccgggaagcctgtacacaagcattcttccgaatctgctcgtaccgaaaatcggagaggaagtcgtcaaggctgcggccaaaaaagtatatatatgcaacgtcatgacgcagcccggagagacgctgcaatacagtgcggccgaccatgtcaaggcgctgaacgatcatatggagcagccgtttatcgacacgatcttaatcaacaatgaggagatccctgacgaaatcaaaagcaaatatgcgaaagagctggcccggcccgtcgacttcaatgttgaaaagctgaaatccatggggcttgaggtcatcagggatcagattatcacgtataaaaatggcgtaatccgtcacgatacacataaagtggcttctcttcttgtcgatttattaagggactagaggccttttgaaatgaggtggctaatatgtcatttgcatcggaaacaaaaaaagaactgacgaacctggaagtgaaggactgctgcgccaaggcggagctgtccgcgctgattcggatgaacggttcactgtcattttcaaaccgccatctcgtgcttgacgttcaaaccgaaaatgcggcgattgcccgccgcatttatacattgctgaagaaacaatatgatgtatcggtcgaactgttagtcagaaaaaaaatgcggctgaaaaaaaacaatgtttatattgtgcgcttttctgaaaatgcaaagctgattttagaggaattgaaaatcctcggagagaactttgtatttgaacggaatatttctgaggaactggtggcgaaacgctgctgcaaacgttcttatatgagaggggcgtttttggcggggggatctgtgaataatcccgaaacatcgtcgtaccacttggaaatcttctcgctttataaggaacataacgattcattatgcgcgctgctgaatgaatttcatctgaacagcaaaacgcttgaacggaaaaaaggctatattacgtatttaaaagaggcggaaaaaatcactgaatttctgaatgtcatcggcgctcacaattcactgctgcgttttgaagatgtgcggattgtcagagacatgagaaactcagtgaaccgcctcgtcaattgtgaaacagcaaacttaaacaaaaccatcggggcttcgctcagacaggtggaaaatattaaatacattgatgaacggatcggtcttgaagcgctgccggaaaagcttcgcgaaattgcgcagctgcggattgattatcaggaggtcacgctgaaagaactgggggaaatggttgcaagcgggaaaatcagcaaatccggcatcaatcacaggctgagaaagctcgatgaaatcgcagaacagctgcgtacaggacaaagcatcactttgaaataaccgtacagaaaaggggagatcttatggttcaggggaaagtggaagtgcgtttaaagacgggattgcaggcgcgtcccgctgcattgtttgtacaggaggcaaatcgttttgcatcagatgtgtttcttgagaaaaacggcaagaaagtgaatgccaaaagcattatgggattaatgagtctggcggtcagcacggggacggaagtcactctgatcgctgaaggcgacgatgaaaaggaagcgctggaaaagttgtccgcttatgtgcaggaagaagtgtaaacactttgtaagggggacggaacgatgaatgagtttctgaaagattgttatcaaacgataggctgggaaaaggattccctcgatttcagcaacctgccggagtttttaaaggcgctcgcatatcggtttccgtttgaaaatcgcgcggttttgtccaaaaaagaatatgacgtcacgaaagaaggactgtggcggcacatggtgaaggaacctcatggcggcctttgttatgacttgaacggactgctttatttcatcctgaaagatgccggatttgatgtcaaattgatccgcggaacggtctggaaaaacggctgggcgctgcccggcacacatgcggccgtacttctttccgccggggggaatgagtacatcgctgatgcaggcttcggcctcaatctcgccatgcagcctgtgccgatgtcgggagacgagacggtatcagcggccggagcgttccgcgtgaggatagaagagacggaattcgggacatacctgcttgaaatgaacaaaggggacggctggcagacaggttacgcattttcgcttgaagaaatcgatgaaaaggacctcaagtctatgaaacaaacaatctttgaacatgaacgctctcctttcaacaaacgcctgcttgcttctaagcggacaccggaagggcacatggttctgtctgaacgcaatataacaataaaaaaacacgatggcacggcggagaacagcagaatagaccgatcagagtttgaagaaaaatttactgctcattttatatgaagctcgcaggttctctgcaaaaaaaacggcctccgcagggaagccgttttttgtatgtgtttatctcatttttgtaaaggttttataatgatctgtcgtcttataaatcagccagtcgcttgagtaaagaatccggtctgaatttctgaagcctgatgtatagttaatatccgcttcacgccacgtccgtccgcttttggcagggagtttgccttccctgtttgagaagatgtctccgccgatgcttttccccggagcgacgtctgcaagattcccctttgatgcaacccagccgagggcctgcgcttctgactttgtaatgtaattatcaggaagcttatgataggtctgaagataatccgcaaccccgtcaaacgtgttgataacctgtgcttcagtgtgcgccttgtgagaagatgtatccgtcttggcagccgtggaaaacagcatccccgccgcggagaacagcaccagcaaacaaacggaaatccacgataatcgttttttcaaagcaatacctcccatttttatcatgtgaagctgattccttttcattgtatcagcatcgagagaaaggaatagaaagaatttaaaaatagttcttttgatctagcaaaaaataaaccccggctgaaacggccgggatttttcatctcattgaaattccttcgtgaggtttttcggcgtttttccgtatacggcgtcaatcatgttttgtgcggcttgcttgaacatattcaaacggatttttgccgttgctgacccgatatgcggaagcaatgtgacgttttccagctgcaggagcggattgtcttcggcgatcggctctttttcaaacacatctaaaccggcgccttttatccagccctcctgcaatgcgcggatgagcgctttctcatcaaccgtctttccccgggaaatattgacgaaacatgccgtatctttcatcaatttaaattcccgctctcccatcatatgatacgtttcgtcagtaagcggcgtaattaacagcacaaagtctgatgttttcagcagtgtatctaagtcggcatatgtaaccccgagttccttctcagcgtccggttttctgctgcgattataatacagcacgtccatatcgaagccgaattttgcccgtttggcagcttgttcaccgattctgcccatgccgataattcctaatgtctgatggtggacatccataccgaaaagagattcttcctcaacggttccccatttgccggcgcggacgaatcgatccaattcggcaacccgtctggcggaagacaggattaatgaaaaagccagatcagcgacagtgtcatctaaggtgtacggcgtatgcgtgccgacaaccccgcgtcttttcatttcttcaatattaaaattatcatagccgacagaattattgctgacgaccttcagcttcggcgcgtgatccagtaaatcactgtcaatcgccgttccggatgtcagcagcccttcagcatctttcattttttcgtacagttcttcttttggaatggtatcttctttccagatgtcataccggcaatgctcgcctatcatttgttcgacttccggcggtatcgatttcgcgatgaatacatagggtttcaacgggcttctcctcctttgtctttcttctctattttattatataagagaagcggtaacgtgagaaatattcaaacgcatcacgataaatttctggttcttttgaacttaaaatgaaagaaaaagaaatgtacatgcttggtttctccaaacaataacagaatccgcctatatttctgaaggcaaaatgagcggaaccgctgttttcaaaagctttataggttggtgtaaagataaattttattatttttgaaagatataaatgaacataatctgaatttacagtcaaattatcgtgtctttttttgaaagcgcttttgaggcctttttctgtgctataattccttactgtaagctgggtaagaaggcttgcaatacaatcggatgggagatgaatagaaaaatggtttctttatcaagcattttggagcacaaccagcagtttgtccaagaaaggaaatatgaaccttaccaaacgacaaaattcccgaaaaaaaagcttgtcatcgtatcctgcatggatacaaggctgacggagcttctgccgcaggcgatgggactcagaaacggcgatgccaaaatcataaaaaacgcgggagccattgtttctcacccatttggaagtgtcatgcggagcattttggttgccgtttatgaactgcaggcagaggaagtctgcatcataggtcaccgcgagtgcggaatgtcgggattaaatgcggcttccatattaaataaagcaaaagagcgcggcgtggaagacaaatgtctcagccttctgcagcatgcgggagtcgatttggaaacatggctgaccggctttcacagcgtcgaagaaagcgtggcccacagcgtgaatatggtcaggcatcatccgctcttgcctgaagaagtgccggtgcacgggctggtgattgatccggggacggggacgttggatgttgtcgttgacggttatgaaacagtcaaaggaggatgcagctgacgatgcaatttaccggcagatatcagggatacaatttgcagaaatttcagaaagacctagtcgcgggaattgtggtcggaattgtagcgattccactgggaatggcctttgccatcgcctcgggggtcggtccggaatacgggctttacaccgttattgtggccggaattctgatttcgctgttgggcggctctaaatatcagatcggcgggcctacgggggcgtttgttcccattttgtttgccattgtgatgcagtatggttttgagaatttactcgtagccggttttatggcaggcgtcatgctcgtcctgtttggcgtatttaagctcggaaagattatgaaattcgtgccgaagccggtgatcgtcggatttacggccggaatcgcggtgctgattttctcggagcagattgcccattttctcggtctgcgcgatatccaaaagcatgaaagctttatcctcaacattgcggaaataggcaagaagatcggaacccttaatttatacagcatcctcatcgcgggaattgctttggccattttgctgttatcagccaggctgatgccgaagattccgggcgcgcttgtggcgctgcttgtctctacagccgcggcggtcgtgttttttcctgacaaaatggcgacaatcggttctgcttacggggaaatcccgcggcagcttccggctttccagcttcctgatttctcaatcgataacatgatcatgatgtttccgtcggctctgatcattgcgcttctcggcggacttgagtccatattatcggcgatggtcgcggacaatatgaaaggatcaaggcatgacagcaatagggagcttgtcgggcagggcatcgccaatatggcagcgccgcttttcggcggtataccggcaacgggagcgattgcgcggaccgcaacaaatattaaaaacggcgcagtttctccgatttccggtgttgtccacggagtcaccgtcctcctcgtcctgctcgtcttcgccccgcttgccgttcacgtaccgctggcaagcatggcgccggtattgatggttgtggcttggaacatgagtgagcggagggaagtcgccaatatgatgcggctgaaaaacactgattcattcgtactggcggcaacctttttgctgacggttctgtttgatttaatcatcggcgtttctgccggtctcgtgctcgcttttgttttctttatcagaaaaatgagcgaatcaacacgtatcaaaacaccgcatgccgctgtcaaatcggttaaaaatgattcgtccgtcagcacatattccattgaagggccgctgtttttcggttcaattgattcactggaaacatcgctgctggagaggcttcaggaaaagccgaagacgcttattctgctgatgaataatgtacattacatggatacctccgcagaagcggtgctggggaatgtgatgaaccggatcaaacggcataacgggagattgatgatcgtcggattgcaatcacagccgagagagctgatccggaagacggggctgtttcataaaatcgggaaacagcatttctttgagcatcaggacgagataacgggataaattcagatacggcctgtccatgaaaaagcggacaggccgtgtttttattcggtttcaaagcgcttgatcagtttttcctgatgggctttcatcgcatcttctaacgtgattccgtacttatcagcaaggatggccagatttccgaggacgtcacccatttcttcaatcagctcctgcctgcgttcagcctgggtcgcgtctttttcatccggccggtctctgccgatttcatatgctcttaccgcccgggcgagctcacccgcctcttccattaaaaaaccgattctgataaatggcccgtacgccgtccatcctcgtttttcataaaaatctttcgtccattgttctgcttcagccatctgcatgtgaaacactccttatgtcctgtatgattcttattgatattatcatatagagatgggacaatatatagtgtattttgatttattgatgtacatatatagatatggagatgaaaaaatgaaaaccatttgtgtatttgcggggtcaaacccgggggtaaatgaagagtacaaacgcaaagcggccgaactgggtgaatatatggcggagcagggaatcggccttgtttacggcggttcacgggtcggtctgatgggaaccgtcgccgacgcgttaatggcaggcggcggaaaagctgtcggcgtcatgccgagcggactgttcagcggagaggttgttcatcagaatctgacggagctgattgaagtcagcggcatgcatgagcggaaagcgaaaatgagtgaacttgccgatgggtacattgccatgcccggcggcttcggaacatatgaagagttatttgaagtgctatgctgggcgcaaatcggcattcatcaaaaaccgatcggactgtacaatgtgaacgggtattttgagccgatgatgaaaatggtcaagtacagcattcaggaaggattttcgaatgagtctcatttgaagctgatacacagttcctcccggccggatgagctgattgagcagatgaatcggtatacatacccgattttagataagaaatggcgggaattgtaagaaagaggtctgaaatatgtttcggcggttgcatctaaccattctgatggaaaattctccgcctatagaataccttttctttctggaaatcgttttctctttctcatgcgtatcacacctttctttatgataagacatatgtatgagaataagatgagaaagagaatgctgttggggttgaaagcagaacatccatttcctcagaggagatggatgttttgcggtttgcagactgtatgcgtttacaacttttgttgcacgaatgtttcctccgatatgaaatcatcctgctgcatcttttgtttttttgaactgattccaaatataccgactgtcagtgcacaaagaaaccagcagcctgtaaagaacaagaaaacacttaaaaatccgtagcctgaatacaggaaactgacgacaaaggggccggctacatttgcaagacgtcctacgccgtaagtgaggccatttccagatgccctggcttcaaccggatataattccggcgtataggcatatgcgatcgaactgaaagtacgctcaaacatatgcatgagaaatccgcatatgacaatgaccatcggcaaaggattgatgccataaaagaatccaagcgccataataattaacgataaaacagaaatggcccactttcgatccacacggtcagagatttgcgacgcaatgagagcgcccagcggggcaccgatcgttcccagagtgacgtatacgatagactcatccattgatacgccttcttttaccaaaagggtgggaacccacgtgccaaagccttgaattgcaatcgtggaagctgcccacatcgtcattaaaacaaaagttcttcctgccaaaggcttttgaaataacgtccgatatggaacggattttacagcggtttgtctgcttcgcagagccggagctggttcaggcagttcacccttttctttttctgcttttgcctccagttcaagcagaatgcggtgtgcttgttcgctttttcctttcgtgtccagccatttcggtgattcttccagttttctggcgatcagcggaaaaaaaataccgaccgcgccgaatagaaagataaaccgccagccgtaagaggcggacggcacgaccaatttagccacccagccggctgcaggaattccgcatatgccgattgtaatacagattgcctggtatttacccttagttgcggatgggaaaaattcgctgatatacgtacttgccacaatcgttgtggcgccgatacctaaactcgtaagaaatctaaaaacaccgagtatttctgggttccaagccagagaagagaggagggagaagaaagagaaaaaggttacaaccagaattaaaccttttttccttccgaaccggtctgaaaaccatcctccggcagaggcgccgataaacattccgaaataggagacagacgtaataaaagcgatggtatgagtagaaatgttccattcctttaaaagtgaaggcgccgcatatgaaaacgtatttaaatcgataaaatcaaaaaagtaagcgaatgaaaggataacgagcactgcttgatgggcccttgaaaaaggcagtctgtttaatcgattagacgcatttacattgatcatctcgtattcctccgtttatctttgacttgtctgaagactggtattaaccaatgtgattcagcgtattcaggttgtaactttgctttgtaaacacatagccttcagagatttttcttgctgtgcgtactactttaatcgttgttccatccggatcaacatctgcctcggtttctaaaatgccgcttggatgtcccaatcgaatcgttctgccatagaatgaaaattcagataatattgtatcctgcaatagcataccggcagtcgtacaaaccgcccctgtaatggctaaagcttgatgcggtttttgcatggacatcatacgaatgacaagatccatctcttctgcgtgtctctttatcccttttgtatcgatataatccgctggagatgagattaatgttagttttggtacggccggtgattttgcagcagcctcatgtctcggagcgaatctgcatttctcggctgcaatcgatcggatcatttcgagcttttccaatatatccggagtatattcatccggaagttctaagccggtaagccccgtgtcctctgcttttacaaagacaagcggattagcgtaatcaataatcgagaccgagatatttccatacggtgtatcgagaacatcaataggctgaccagtgggaaacagcttaccggtcaccgctccttcagcctggtgaaatgaaagataaataggagaagctgtacctggaaccccggggatagagcagtccccctggtaatgaaatgttccatttctgacttcaacttctgctacgatcactttttgagtgtttgtatttaacattctgacttttgtaaccggctcttcagcttgaacgagccctttctcaatagcataagggcctacggcagcagagatatttccgcaattgcctttgaagtcggtaaaatggtcagtcaaactgacctgagcaaacgtatactcaacatctgcatcctttctggcggatttcttaataatggctgccttgcttgtgagagaatggccgccgccgagaccgtcaatttgtctctcgtcagggctccccataatgtctaaaagaaaatcgctccataggtttgtatcgtctggcatgtctttttgatgaataaaaacgcctttgctggtgccgcctctcatgacggttacaggaactttttccatgctgtctcatccttacatcattttgtgtggataaaaaggtaccggtccctttggaaaatatcgtatgataaattaggattataagtaaaacatataatttttataaagttgaataaaaaacttttataataggaggaaattttatagcagaaaaatattttgggggatttcatatggatgaaaaggattggattgtgctcattacattattcgaagaaaaaaatatgacgaaggcggcagagcgattatatatgacacagccggcgttaagttatcggctcaaaaacctggaagcacaattcggagtgcgccttttttataaaagaaaaaaagggatggagttcacttcagaaggtgaacatctggttgattattcgaaagagatgctgcaggaattcagaagagtgaaggatgatatgctcaatatgagccatgaagtcagcggggttctcagattaggagtctcaagcaattttgctcagtataagctcccggcgattctaaaacggttttctgatcagtatccgtctgttcaattccacgtcaatacgggatggagtgcgaaggtgatggatttgcttcatcattcgggggtacaccttgggattatgaggggaaattatgattggcaaggggaaaaacaactgctaaatgaagagcggctgtaccttatttcaaaaactgaaatcaacagtgaggaccttcccaaattgccgatgatttattatcaaactgatgcttctttgaaaagtttgattcaaaaatggtggaataaccaatttactgaaccgcctttcattgcgatggaggtagacaggcaggaaacctgtaaagagatggtgaaaaacggtctcggttattctgttgtgccggaaatctgtcttcagccttctgatgaattatacacattggcgctatcctataaaaataacgagcctgtgatacgcgatacttggcttatgtataattcttcagcgttagaattatctgtcgtcaaagcattcattacttttttgaatgggaataaagcataaaaaaacctgcaagagacatcagctcttgcaggtttttttggcattacttctggtcttctgtattgcgtgtcagcactttatcgattaagccgtattctaaggcttcatcagctgatttgaagttgtcgcggtctgtatcgcgctcaatgacttcaagcggctggccggtacgttcagcaagcactttgtttaatttgtcgcgaagcaagagaatgcgttttgccgcgatttcaatttctgtcgcctgtccttgcgctccgccaagcggctggtgaatcataacttcactgttaggaagcgcgtaacgtttgcctttttctccggctgcaagtaaaaatgctcccatagaagcggccataccgatgcagatcgtggatactttcggtttaatgaactgcattgtatcatagattgccataccggcagtgattgatccgccagggctgttaatgtaaatggaaatatctttttcagggtcttccgcttcaaggaataaaagctgtgacacgatggagttcgcaacgttgtcatcaatcgcagatccaagcatgataatacggtccttcaaaagacgggagtaaatgtcataagctctttctccgcggttcgtttgttcaatgactgtaggtattaaattcataatgctcctccttcaccttttaggtaagtatgtatttacatgatacatttttggtcaataaaggtcaaacaaaacgctgaccaaaatgccaaccttttcttctaacaccatttttcccataaaacaaaaagttcaaacagcaaagtggaaatgaggatgatcagcgccggagccttgagaaaatgatatggccggagcgctcaaaatagaccgcaatcgcgtcgctacgtacggctgaagggtctgactacgttgtccgcccttccaaaagccgtaccggcaaatacgtttccagcggcaaatcatcaaattcgccttcaatttcttttgctaaaatctcgatggctgttttggaaatcaattcaatcggctgctggatggttgccaagtccggcagaaccgattgaacggtttcagtgccgtcataaccgatcacttttaattgattcgggatgtctattccccgttttttggcctcggtcatcactgcagccgccatgatatcatcgctggcaaaaattccgtcggtgtcgggctgttcatcgaataatgttgaaataatgtcatggtaatgctgataaaagggtacttcatatgtaataggcttccgtccgtgttcatgcatgacgtcttcgtatgcttttcttctgaggtttgccggtgtttcgagttcaatcgggccgttgatatggacgatgtgccggcaccctttttcaatcagcagttctgccgccttttttccgccgtcatagttgtctgagccgacgacgggaatcgtgtccgataagtaatgatcaatggcgacaatcggcagattttgcttgtgataattgagaattccccggttgtaagtcacggcgatcacgccgtccacttggtttcttatcagcatctccaaatatttttcttccttatcctttcgatgtaaactgttgcaaagcagcagtttgtagcccatggacgtacaaatgctttcaatatgaaaggcgagttcgccgaaaaacggattgctggagtttgggatgataagccctattaaattggttcgttttcggaataaagagcgggccagatcgtttggaaagtaattgatttcttccatcgccttgtacactttttcttttgttttttcgctgatatagccgcggttatttaatacccgcgaaacggttgtagatgaaactcccgctattttcgcaacatcatgaatgttaggcttcattcccgtgccctcctgcttactgaaatggcttacaatttccgtcacgcacttattttagagaatcaggctgacatgtgcaaggacattccgtgtttctgttttcatataaagagggtgcgttttgtttgattaaaataatcagaaaattgtatgtcaaccgattgacatatggaaccggttgacatacaattctttttgaaagcgctttattctcagagtgaagggaagtgacgggtatggagagatggctggcggcaataaagtgaaagaatcgagcagcgatggaaagtaagcgcttactcagagatcgcatgtatatgatgaaaatgaagaaggaagtatgcggctctaaaacggctattaaaaggtcctattaaaggagcggtgcaaatgaaaagctcaaaaagtctgtattggaaactgagtgcttatttcttctttttcttttttacttggtcttccagctattctttatttgcgatttggttagggcaggaaatcaatttaaacggatcagcgacaggcattatcttttctgtaaacgccgtatttggcctctgcatgcagcctctttacggttttatctctgacaaattggggctgaagaaaaagatattgtttatgatcagctgtcttctcatattcacgggtccgttttatatcttcgtctatgggccgcttttacaatacaacgtctttcttggcgccgttgtcggaggcttatatttgggagccgcttttttggcggggataggcgcgattgaaacgtacattgaaaaggtcagccgaaaatatgatttcgagtatggtaaatcaagaatgtggggctcgctgggctgggcggcggctgcattttttgcagggcagcttttcaatatcaatcccaatatcaacttctggatcgcgtctgtttcagccgtcatattaacggccattatcatgtctgtgaaaatagaaatgactgatcatgagaaaaacagagcggattcggtccggttaaaagacgtggggcggctctttttactaagagatttctggttttttatgctgtacattatcggggtgacttgcatttacggcgtatatgatcagcagttcccgatctactatgcgtctttgtttccttcagtgtcgacgggtaaccaagtattcggctatctgaattcattccaggtgtttttggaggccggcatgatgtttcttgcgccttttatcgtcaataagttcggggcgaaaaacagtttgattttagcggggtttttaatggctttccgcatcgtcgggtccggaattgcagttgagcctgtaggcatttcatcaatgaaactcatccacgcactggaattgccgattatgctgatcgccgtttttaaatatttggctgccaattttgatacgcgtctgtcgtccgtcctttatctcatcggttttcaattcgcatctcaggcaggcgcgtcgattctgtcgccgcttgcgggaggattatatgacagtgcggggttccgtcaaacctatctcatcatgggaatcgtcgtcttcggttttaccgtcatctccatatttactttattgggcccgaaacaaaacagcaggcgtgtccagcgtctgcaaaaaatcggatagagaggatgttacaaatggatagaattcagcaggcggaagaagctctgaaggaagccgagggtaaagtgaaacaaagatatcgattggggtaccatattatgccccgggcgaattggatcaatgatccgaacgggcttattcagtttaaaggagaataccacgtcttttttcagcatcatccgtatgatgagcattgggggccgatgcattggggacatgtaaaaagtaaagatctcattcattgggagcacctgccggttgccttagctccgggcgatgcattcgaccaaagcggctgtttttcgggaagcgcggtcgatgatcatggaagattagccctcatctatacaggacataatataattgatcaaaagaaagacctattctatcaaactcaaaatatcgctgtcagccaagatggaatcgtgtttgaaaagcttcaggaaaaccctgttattgcggaaccgccggaagacagcgcccgtcatttccgcgatccgaaagtatggaagcatcgcgatgtttggtatatggtcatcggcaactcttcaaaagaaaacgtcggacgggtcgttttataccgttcacctgatttgagtgattgggaatacgcgggggttctcgcccaaagtgacggtaatctcggctatatgtgggaatgtcctgatttctttgaattaggcggcaagcatgtcctgctgatttcaccccaggggatcgaggcggacggtgattcatatcaaaatttacatcaaaccggttatttaatcggtgactatcataatgaaacaaacaaatttacacacggtgcttttaaagaactggatcacggccatgacttttacgccgtgcaaacattattagatgataaaggacgcagaattgctatcgggtggatggatatgtgggaatctgagatgccgacaaaagcggacggatggtgcggtgcattgactttgccgcgagaactgactttgcgtgatgatcataaacttttgatgaatcccgtggaagaaaccaagcagctgcggaaaatggaataccgggaatgtgccggacgatcgctttcagggagttacttggcaaagacgtccgaagacctgcttgaagtccgggccgtgtttgatgtgaacgattctgatgccgaaacggcaggttttaagattcgcggccttgatgaagaagaacttgtgctgacatacaatctaacggataaaaagctgacgcttgattgcaccaagatggggaaagcgaaagacggtgtgagaagggtgcagacggatacaaacggcaagctggcgctgcgtatctttattgacagatcctcgattgaagtattcgccaatcatggagaaacaacgatgacaagccgtatctatccgaatgaaggcagattggggattgagctgttttctgagaaaggcgccgtaaaggttgaggaattcacctattggacgttaaaggacatttggaaaaaaagctaaaacgggtgattactgctttttctgcagtgattgaaaatgaaccgagccgggggcagtccgcctgaaatgggttttttgtgaaaatcaatgccggtaaacgatgcaggattatgctgcatgaggacgctgcataatcctgttgtgcattatcaaaaaagagttgctttctgcgcgttcctttattataatataaaggtatctgattgaaaaaacgtgcgctcgtagctcagttggatagagcggtggtttccggtaccacgtctgtcgggggttcgaatccctccgagcgcgtctcagttaagaggataggaaaaacctcgcagatgataaatctgcgaggttttttattttatcttgttttgaaactgttaacgaatgtgtctctgttatgttcggttccggcaatcagccgcgcactttcactgatccgctgcgcgagagctttttgcgccttgccttcaaagctgttcaatagtgctgaatacacttcatataattcatctttcaacgtatccatttcgaatgtcggtttcagcgttcggcggactgtttcaagttttgtccccgctgcctgcgtcatccctgttttcagcatctgccgctgcagcattttcttcatcgggtcgtccttgtgttctaaaagttcgtctaatgtcggcattatgtatacacctctatcatcttaaccagtttgcgagcatctggtcttttttctgaaattcgtctgctattttatgtaagaatccgccgatctcttctaggtccgtgatcgccgcctgcaaagaatcaataaacgcctgctcagcctgagtgtcgtaaaaaatcgggcctttatcgtaggattgcgcaatatcttcaatggtattggtcacgtcctgtgcttgaagctgatcaaacaagccgtgtccgacttggccgtaaatttccgtttttagctcggcgattttttcatcgtgctcctgataggcgttctgcgcttcttttttcatcgtccgtaaatcctcagtcatggcctgcaccttttcagccagcttctttgcgtttttcggcgttacttttattgtatctgcgcttccgatcgcaccggccggcagaagagcgccgaggtttttgtcaaagactaattcatctccgttcggatttgtgatgcttccgtttcggtcaaatatgaaattcgcttcatttaagccgtgtgtatccggatttctcagaatgacggtagtgaagaaataagcgagattcttgccgatctgctcgttcaagttcccgccaagccgctgctttcggctgaactgtgagagcgaagggtttttcgtataaatcgttgtcccgttgtggcggtcatattcgttccaataacccgccccggccatgtcgtccggattgataattgaccggatgtatggatcgtatatgccgctgttgatttctttctgtgtttcttcatcgtgcagttttacgacggaagggctgttaaacgcgacggcgtacacatcattattcactgcgctgtattcggcctcagcgccgccgagtgaatggccggttgttgaaataatcgttgacgttccggcatactttttctttacgctgcgtaccagctgatcggcttgatcgatttgcgaagttttcgtcatcagcttatactttccggttgtgagcatggcgtcttgagagggcgttccgtgataggctccgagcgttttcgaggtatcctttgcgtctttttttacaatataatgtacttcttttttcggatcatttccgaaaacaatattgccgccgtccgcttttacgccgtcattgatcgggtcttttccgatatcggttcccgcaaaggcgacgaccacgttttcggggttttttgattttgtccattttccgttattcttcactgcttgtgctaatacaaccgcatcaagtcctgtattatcgtctgattttatttgatcgacgcaccagtaagtaggttttgaaatggaagaattaaagcgtatataatcgttcttctctaatttccttttaagatagtcatagttataagcacgttgactcatcctgtaatatgtttcatctgtcaggtttgaagtcctgattttcttgctcaagatatacagcacctttcttgtcatgtaaaatagggtagggaaagggatgattttttttgaaaaaataccttattattgttctagtgttaattataaccgttggagggttgattatgaagcatcaatatgatgggaaaaaggaagaaaatgctcttttcgaaaaagccaaaagtaaaatgaccgagtacttgcgtagtgagtataaggatatagagaaaatttcttatgatgattattttattgatccaaccggcggaattacagttgaggggtacctaaacggcgataaaactaaagaatttgacggcttatatgatcctgtaggagacaaaatagggagctcctctgtggatgcggaagaaaaatcttaagacgcctaaatgcacctgtcaccgaccattttttccagtccgcgagcttcatcatcactcatggaacggatgtttctgtgaaaaatatattattatgttcattatcttaatagcagccggaagttttataatgaagaatagtaatgataaaaatgctcaggctgaagagataaagattgctcaagaacgaatggagaaatttatcaaatcgaattatgaaggcatacataacgttacatttaaagataaatacgaaatagatccaatgggcgggatagaggtatttggctattacaacggtgatacatcgaataaattcgatggtatttacgataaggcaaatgacaagatcatggggcactcaatagacgctgtaagaaagaatgcagagataaagattgcgattactaagaagacgctcgtctggcgttttttgatatatgagtatacagcaaatgaaaaagacaagggtttcggcatgtgccgcccttgtctttttttattgaacactgaaaaacataaccggaacagctcattatttgacagtccattttaacagcgttacaattaaacatgtaaatagttacatgtttaaataaacataatatctcgggaggtgatacgtccttgaatgaaccttctttaaaaaagtcatttatgagtcagtgaaccgcatcattgatcccgagcacgtgtatttccgcactgtgcctgtgtttgaaacaagcagcgaggcatatcagcatctgcaggaccggctgtttatcggggctgcggtcagattgccggatgacattcggttagatatttatgaagttcaataataagatggagagtgagtcaacatggaaaactttatcggaagccatatgatttacacgtatgaaaacggctgggagtatgaaatctatattaaaaatgatcataccatcgactatcggattcatagcggaatggtgggcggccgctgggtgcgcgaccaggaagtgaatatcgtcaaactgacagaaggcgtatacaaagtgtcatggactgaaccgacaggcacagacgtttccttaaactttatgccgaatgaaaaacggatgcacggaattattttcttcccgaaatgggtgcatgagcatccggaaatcacggtgtgctaccaaaatgattacattgacgtgatgaaagagtcacgtgagaaatatgaaacgtatccgaaatatgtcgttcccgagtttgcggatattacgtatctcaacaatgcgggaatcaataacgaagcactgatttcagaagcgccgtacgaaggaatgaccgatgatatccgtgcgggaaaattaaaataagagaaaaaacccggcagcttggccgggttttttgtatccttttacgacagggttttggtcatgataaagtcgacttgcttatcatcccccatataaaaagagtgttctccagtttggacaaaccccattttttgataaaaggcgattgcattttcgtttttttcccatacgcccagccagattttctttttattgtgtgctgttgcgattttcacagcttcattcagcagatatttgccaagcccgtgtttctggtggttttttcttatataaattctctcaatctcaagagaatcttcacccattttttctgattgtgcttcgttcatgttgacttttacataccccgcaaggtcatcatgataataaacaaaatagaatttagaagacagattggataattcctttttcagctgttcagagcggaatgcattttccaaataagctttcatattttctggtgaattttgatccttaaatgtatcattgaatgtttcaatgcttatctcccggagctctgttatatcgttaaggctgcacttttttaattgaatactcatggtcatacagctcctttcttcatttatcatatcagctgattttttgttgtatttgcaatgaaaataccgtatagtaaacataccgtaattttgttgtatttgcaacataaaataagaaaatgaggacgataaagtgaaatatgttttttatgttttaggaatcatgatcttgacctttggtatttctgtcacgattcaatcagatcttggaacgtctccttttgatgcgcttattgtgggattatccgtccatgcagggcttaccgtgggaagctgggaaatcatcatcgctttcctgttaatttgctgtaattcaatgttaaaaagacaaagaccggaatttacagggatgattacggcgtttataacgggaatcgggattgatatgtggctttttttcctgcaccgaatcataacgcctgaaccatggtacggaaaggcgggctgttttgcaatcggtttagttgtgatagggataggaaccgcaacctatctgcacacaaatttcgccccgatcccggttgatcggttaacgttaattgtccgcgaattaaccgggagaagcatctttttttcaagaacggtcatttacttcatatttttcatactggccgtgatgctaaaaggtccggtaggcatcggaacgttattaacagtttgtttaggaggggtcattctccatttctttatgccgattaccggaagatggatagacggcatattaacagcatctccaaagcaggaagaaacgaaaacccggtagcgggggtttttacccgattctatcatttttcatttcatccgcatgttcaaggtataataaaaaagggggagggatttttatgagcggtcaaagaaagctcgttttttacggagctgtcagcgcagatggctatcttgcgcgggaaaatcactctttagattggttaatcggaactgaaggtgaagacggcaccgattatgaagctttctatgaatctgtcgatacgatcatcatgggcagaaaaacatacgaggacatattggttttattgcctgaggaatttccgtacaaaggtaaagaatgctatgtgttttcgcggacattgaccgggcgtactgaacatgtgcggtttgttcatgaagagcctgccgattttataaaagcattgaaacgccaagaaggcaagcggatttggattgtcggcgggagtgatctgctgcacccggttttggaggaaaaacttgtcgatgagtttatcattcagatcgcccccgttctgctcggacgcggaatttctttgttcaaacccggagaccgggagacaggactgaagctgactgatgtcaggcgttacaaacaatttgcggagttgcattatgaagtgagataaaatgaagtgtatgaaagaaacccagtaaaggttaccgggtttctttttcatgtctgtttttatgttttgaaatggtgtgggccggcccgcatgaaaatcctgcaatcatgataacaacccctatccacctcacggcatagaaatcagtgtcgcgcaggaagataaatgaaactaaggtcataagcgccccgattataacggcagctgtgccgataatacttgatttctccatataaaaactcctttatgaatgtttggttaacttattgggttagaatataacatatcaggggtaatgcggaaatggattttctgcgatgtctgaagtaagatgaaaacgaaacgccaagggagccggctcccttggcgttttttatgcttgaaacaggatgcggcgttttgctgaatcgggatcactttcgacagcggtatccgtgttgaaaagcaaagttttgcgtgaatcggtatcatattcaggccaattgaagtgagaggtgttcgggtttccggtttttgcaaaagcgagccatgcggattggatttgtttggaaagctgttctgcgtcatcaccgagcggttcttgcagcgtctttctcaaagaatcaaagtttccgaacacaaatggcaattccagagcgtgaacggctttatgaaacggcggtgtttcgccatgccaatcaaagcggtacatccagaccggtgcgtgctgcgactgtccttgtgcgaaagcgacagccggccgccagaaaatcagatccgtcatcatatcgatttgtccctttaatgaatgcggatataaatctgccgcttgctcagtgcagttctctccgagatgataatgcaaataatcttgctgctttttctcggaatgaatgtctgtatcaggggtgaaaaacaaatatgcttcatcacgattggttccgatgatcataggtatgccttctgcggccccgtctgctatggctttcacgggttccgcaggcaatgtggccggatcgatggcgggctgaaacaaaagctgaaaaatgttttgatctagtgagcgccgcactttatccgcagtcttaagcaggtcattaacggaaagctcctgcaattgatcagtgccggcttcatgaataaatgccgccgcgatgtcttttgccatgtccgccgggatcgtatgagaggcgccgctttctaaaatggctttatgaaacaggccttttgcgtcaggcattgccataagggaggcgatgctcatgccgcctgccgattcgccaaatatcgtgacgttatccgggtctcctccaaattcggagatattgtccctcacccagcgcagggcggcgatctgatcgagcagcccgatattggcggaatacgcgtcgtgaatagaagacaaatgtaaaaagccgaacggtccgagcctgtaattgagtgtcactacaatgacatctccgtcagcggcaagggcagatccgtcgtaaagcggttcgcttccggcacctaaataaaatgccccgccgtgtatccataccatgacaggctttttttcgccctctgaatcgggggcgaaaacattgaggtaaaggcaatcttcagattgaggcggtacatctccggaaaacgatatagacagcatatcatccggctgcggacaaaccggtccgaacgaatcggcatgttttacgccgtcccaaggtgcgggcggctccggcgctttaaatctgagctctccgacgggcggcttcgcgtacggtatgcccttccatgtgcgggcaccgcggccggcagttcctttcattgcgccggagcgggtttgaacggtaagttttgtcatgatttcatccccttttttcttttcattataaacagagatgaagacatgaagcgaataaaagccttttcatcagcatatcattagtaacgcttccgttctaaaaatgatctgacttcctgaacggacaagccgagttctttggcttcctgcatcagcgctttccattcctcaatgttggattcagtcagttttctgttgcggtagggtgcgggctccgggcgtttttcagtcagtttgttcgtaaaggtgaacagttcttctttcggcatgcccgactgcacggcctgcacaaggtggatgcgccactcatcttccgtgcctcccatgtgatgcagcatcgtttcggcatcaaaaagctccgtcagatcgacctgcagggtggcggatacttttttcagaaattggatggacggatttgagtgaaccccccgttctatcttgcttaaataagatttagagacacctgcttcaactgctagctgattaatagagtagccttttcttctgcggtataaacgaattattcttccaatcattgtgctgaattctcccctgtatactggcatttttttgttcattataagaaatttttcgttctttataaaatttaaaattataaggtaagtgcagtaaataagaggaaaatcatgataatgttctttaaaaagaaccaaatggcttaatttgaaattttcaaatttcgaccttttcttttataatccaatcattaacagaagggggcgtttaagcctgatgcaataaggatgaggctgtaattacatgaatgagaatatgagttttaaagaattatttgacattattaaacacagacttttactgatttttatcatgacagcagttgtaacgctggtgacgggatacatccaattccgggtgatttcgcccgtttatcaggcatcgacccaagtgctcattcatgaaacaagcggtgaaaaaaattcgaatctcagcgacgttcagctgaatcttcattacaacaatacgtttcaaacgataatgaaaagcccggtagtgcttgagaaagtgaagcagacgctgcatctttctgagacggcatccgctttaaaagcaaagatcacgacaagcagcgaaaccgattcagagatcattaccgtagcggtgcaggacgagaacccgaaacaggccgccgctatagcgaacacgctgatgaagacatttaaaaaagaagtccgtgacaggatgaatataaaaggcgtcattgttttgtctgaggcaaaagcatcggaaagcccgatggtcaaaccttcgcgcatccgaaatatcatgatggcgttcggtgcggctctcatggcgggtgtgacgcttgcgttttttctccactttcttgatgaaaccgttaaaagcgagcggcagctcagcgaaaaaacagacttgcctgttttaggggttgtgtatgacatcaaaaatcagcagacacggtctgatgaaaaacatttcggggagtgaggcgtttgggattcagaaaaaagaaatcaagaaggggactggctcaaatatccgttttacatcacaaatcattggtggctgaacaataccgcaccattcggacaaatattgagttctcctctgttcagacccatttgcgctctattctcgtcacttcttccgttccgggagaaggaaaatcattcagcgccgccaaccttgccgcggtatttgcgcagcaggaaaaaaaggtgctgctcgtcgatgcggatttacgaaaaccgacgatacacgagacctatcagcttgaaaatgtacaaggccttacgaatgtgttagtcggaaacgcttccctcggcgaaacggtgcaaaaaacgctgattgataacctttacgtcttaacgagcgggccgacgccgccgaatccggctgagcttttatcttcaaaggcgatgggagagctgattcaggagatgtacagccggtacagtctggttattttcgattcacctccgcttttggctgtggcggacggacagattttagcgaaccagacagatggaagcgttctcgtcgtcttgagcggaaaaacgaaaatggataccgtccaaaaggcgagagatgcgctccagcagtcaaaggcaaagcttttgggggcgctgctgaataaaaagaaaatcaaaaaaacagagcactactcatattgagcggtgcaggtgatgtctccttacctttatcaacggaggcactcggctctgctgtgggcggcgttttccgctgccttagatgctggtcgtcggtggcggggtgtgaggacgggttaaatgcccaattttatcttaagatgatgcattgttatcggcttagctgttatgtctgtttttacgaaaaccgtatcagctaaaccgataaatgaggaggggaaagattgacttaccggagaagactttcaatgatttttgcattggatacgtatctcgttttactttccgttgttataggatatcaattttttgaggattcttatcacttttatgactccggagcgttgctgctgactgccgtgagcatgctgatcagccatcatgtatgcgcttttatgtttcaccagtataagcaggtatggacgtacacgggaataggcgagctgcttgatctgctgaaggggatcacgctgtccgcagctgtgacagccgccgtccaatacggggtgttccacacgattttgttccggctgttggccgtcagctggatggttcagctattgttcatcggaggaagccggatgatttcacgggtgctgaaagaaacgatcggcaggaagcaaaatgactcttccagggcgctgatcatcggcgcaggtgcgggggggacgctgctcgtccgtcagcttacccagaaaaacgatctcggaatcatgcctgtggcttttattgatgatgatcagacgaagcataagctcgaaatcatgggcctgcccgtcatcggcggaaaagaaagcattatgccggcggtgcagaggctgagaatccaccatattatcattgccattccgtctctttgcacccatgagcttcagacgttatacaaagaatgtgtgcagacgggcgcccatattaaaatcatgccgcaatttgatgagatcctgctcggaacgcaggctgccggacacatcagagatgtaaaagccgaagatctgctcggcagaaagccggtcacccttgatacgagcaaaatttctgacagcatcaagggaaaaacgattctggtcacgggcgccggcggctcaatcggttctgagatctgccgccagatcagcgcgtttcttccgcgggaaatcgtccttctcggccacggggagaacagcattcattccgtacataccgagctgtccgcacgcttcggcaaagaggtgctctttcacgcggagatcgccgatattcaggacagagataaaatctttgctttgatgaaaaaatacgagccgcacgtcgtctatcatgcggctgcccataaacatgtgccgttaatggaacataatccggaagaagccgttaaaaacaacattatcggcacgaaaaatgtcgccgaagccgccgacatgtgcggaacggaaaccttcgtgctgatttcttctgacaaagcggtcaatccggccaatgtcatgggcgcgacgaaacggtttgcggaaatggtcatcatgaacctcggaaaggtcagccgcaccaaattcgccgccgtccgtttcggaaatgtgctcggaagccgcggcagcgtcattccgattttcaaaaagcagattgaaaaaggcggacccgtcaccgtcacgcacccggcgatgacaagatattttatgacgattcccgaagcgtcaagactcgtcattcaggcgggggcgcttgcaaaagggcggcagattttcgttctggatatgggagaacccgtcaaaatcgtcgatctggccaaaaacctgattcatttatcaggctatacgacagaacagattcccatcgaattctccggcatccgcccgggagaaaagatgtatgaagaattgctgaatcataatgaagtacatacggagcagatttttccgaaaatccatatcgggaaagcggtggacgggaattgggccgtgctcatccgttttatggaggaattcagccgtctgcctgaagaagagctgagaaaaaggctgtttgaggcgatcgaatcagtacatgaagaagcggccgcaggcgtgtgatgggaggacagaaagatgacgaaaaaagtattattctgcgccactgtcgattatcattttaaagcctttcatcttccgtattttcaatggtttcaggatatgggctgggaggtgcacgtcgcggcaggcggcaatatgaatcttccgttcgttgatgaaaagttttccattccgatccggcgctcgccgtttcatcccgaaaatctttctgtttacaggcggctgaaacggctcattcaggacaacggctacgacatgattcactgtcatacgccggtcggcggcgtgcttgcacgccttgctgcgagacaagctcgccaaaaagggacaaaggtgctgtacaccgcgcacggctttcacttctgcgacggagcgcccctgaaaaactggcttctttattacccgatcgaaaaatttctttcttcttatacggattgtctgattacgattaatgaagaggattacgaacgggccaagcaaatgaaaaaaacagcttgcggcgcgaaaaaaatacacggcatcggggtgaatacagacaggtttcgccctgtgagccgggaagagagtgaacgtctgagagaaaaacacggcttcggcgccggggaatttattctcgtataccccgctgaattaaacggcaataaaaaccaaggacttctcattgagactgcggcactgctgaagaaccgcatcccggagctgaaactcgtatttgcaggagaaggcgtgatggaagcgccgtacagaaaaaaggctgaatcactcggtgtatccgacatggtgcggttttacggtttttgccgcgatattcatgaactgattcagcttgccgatctgtctgtcgcctcaagcatccgtgaaggactcggcatgaatctgcttgaaggaatggctgccgaaaagccggccgttgccgcggacaacagggggcaccgtgagatcatcgaagacggcgtgaacggttttctcgtgccggccggggacagcgcggcatttgccgatcggattgaaaagctgtaccgctccccgtgtctgcgaaaagcaatggggcaaaaagggcgcagcacggcggaatgtttttctgaaacacgtacggtaaaggaaatggcgcacatttacgccggttatatggataaaaaggagaaaagcgtatgaatgcaggagcacaaccgaaaatttccgtcatcatgggaatttataattgcgaagagactttagcggagagtattgaatccatcctgagccaatcttataagaattgggaactgattatgtgtgatgacgcgtcaactgacggaacgtatcagattgcgcgccgttacgcggatcattacggcgaccggatcacgctgattcaaaataagacaaatcaacggcttgccgcttcgctgaaccgctgtctgacatacgcaacgggggattatatcgccaggcaggacggtgatgacatctccaacccgaggagactggaaaaacaggccgctttcttaaacaagcacgcccactatcaagtcgtaggcacggggatgctcgtatttgacgaattcggtgtaaggggcgcccggcttttgccgcccgtgccgaaaccgggaattatggcgaaaggcacaccgttctgccacggcaccattatgatgcgggctgaagcgtacaaagcgcttggcggctaccggtcagtcaggcggacgcggcggatggaggatatcgatttgtggctgcgcttttttgaagcgggtttccgggggtacaatctccaagaaacgctgtataaagtaagagaggacagtgatgcgtttaaaaggagatcgtttacgtattccattgataacgcggtcctcgtttttcaggcatgcagacggttgaagctgccgctttcccattacgcgtatatcgcaaaacctctcatccgcgccattacgccgcccgcggtcatgaaccgttatcataaaaacagggacatccgccaaaaagaagggcttgccgaacatgactgacaaaccgatgcgggtgctgcacatcttcagcgggatgaacaggggcggcgcagaaacgatgatgatgaatttgtaccggaagatggacagaacgaaggtgcagtttgattttttaacccataggaacgatccgtgcgcttatgatgaggaaattctcgctctcggcggacggcttttttatgtgccgagcatcggcagcacaaacccgattacatttgtgaaacaggtcaagcgggtgattcaggaaaaaggcccgtttgccgccgtgcacgcccataccgattttcagtcgggattcatcgcgcttgccgctcgtttagccggcgtcccggtgcggatctgccattcgcatagtacgtcgtggcgggggcgggcgtcgcggcttgccgggatgcagctgtttgttttcagacggctgatcacggcaaacgccacggcactgtgcgcctgcggagaagacgcgggccgtttcttattcgggaaagaaaaagacgtgcatcttttgccgaacggcattgatctcgacttatttgccggcgggtgcgcggacacagaagctgaaaaaaggaagcggggcattgcaggcggccgtttggtgatcggccatatcggccgctttacagaagaaaaaaaccacgaatttctgctccggctggccgctgatatgaaagagcggggcatcggcttacagctgattctcgccggagacggtccgcttcgcaccgacatggaaaatctggcggcgaagctggggcttgatgatgatgtgcgttttatcggcatagaagaccgcgttcatgccctgctgaaaacgttggatgtatttgtcatgccgtctctttatgaagggctgcccgtcacgctcgttgaagcgcaggcctccggggtgccgtgcgtaatatcagacggcataacggaagaagccgatgcagggctcgggctggtcaaaaggctcagcctcaaagaaccgcccggacaatgggcatccgcggtgttacgggcagcagaggcggcaaagcctgacggggagcgcattaaagaaaccctcagacggcagggatatgacgcgggagaaaatgcgggggctgttatgaagctttacaatatgaattggaaaaaggaacagtaacgaatgattgtatatgtagtcaatatgggaattgtgtatatttggtcatggttcgcgaaaatgtgcggcgggcgtgatcaatcgctttcgaccggataccggccgaatcagctcgtcatgatcgttccgctgctatcgctcgtattggtctccggtttgcgctacagagtcgggacggattttcagacgtacgcgctgatgtacaagctggcgggaaattacggaagcatttgggagatcttcgggttcggagcgaaaaaagcagccgttgatccggggtttacggctctcatctggctcatgaattttatcacgaaagatccgcaaatcatgtatttcaccgtggcggtcgtgacgtgcagctttattttaaaggggctcgttgagttcggccgtccgtttgagctgagtgtgtttttgtttttgggcacgtatcactattacgcttcctttaacgggatcaggcagtatatggtggcggccgttttgttttgggccgtccgctacgtgatcagcggaagctggaagcgttatatgtcaatcgtgctgctgtgttcgctttttcattcctcagcgctgattatgattccggtttattttctcgtcagaaaaaaagcctggtcgcccgcgattttcggactgtcggcattgtttcttcttatgacgtttctgtatcagaagttcatttcgctttttgtcgtcgtgctggaaaacagctcatacggccattatgagaaatggctgatgaccaatacgaacgggatgaacgtcgtaaaaatcgcggtgctgcttctgccgctgtttttggctttctgctatcgggagcggctgcggaagctctggcctgacattgatgtcatcgtgaatttctgtctgctcggcctgctcttcggtcttttggcgacaaaggatgttattttcgcccggtttaatatatatttcggcctgtaccaaatgatcctgatcccttattttgtgaggatttttgatgaaaaatcaaatgcgctgatttatatcgccattattgtctgttattttctttacagttacttgcttatgccggtcgattcgtctgtgcttccgtacagaacgattttttcccggtaatggacattggaggtttatatggaaacacccgcggtcagtttattaattgctgtgtataatacggaaacttatttagaaagatgcttagattcattgctcaatcagtcgctcgccaatatcgaaatcgtggccgttaatgacgggtcaacggatcaaagcccggcgattcttgaaacctatcagaagcgggatgagagaatccgggtcattcatcagcaaaaccgggggctcggcgcggtccgcaacagggggatcgaggcggcgcgcggcgaatttatcgcttttattgatgcggacgactgggttgaacctcattattgcctgcgcatgtatgaaaaagcgaaggctgatcaggctgatctcgtgatttgcgaatatgcggccgaatttgcggatacggggaaaaccgccgtttcaacgatcgcttcagcgtacgcgggccgcccgaaacaatggtacctgaaagatttatttgaaggaagagtcagcggtttttcatggaacaagctgtacaaaagaaccatgatcgagcatcatcagctgcgctttccgcttcgtgatgagctggagcacgtggaggatcagtacttcagcctccgggcgcatgttttcgcaggtgcggtctcgtacgtggatcagccgctctatcattatcggattcacttgacttccattgtgcaaagctatcagaaaaagctgtttgactcaggtctcgttctctatcggctgaacgaggcttttttgcgtgaaaacggctgcttacaggaataccggcaggagctggattttttcatcgttcagcacggaacagtctgcctgctgaatgaatggaagcggaataacggcggccggttttctgagaagtggaagaatatcagccggatatgcgctgatcccgtgtttcgcctgagcctttccaaaaccggaacggcgccgtttgacgccaaacgctcatgccttctgcttttggcgaagctgaagctgattccgttcgtgtcgctggcatcagccgcgtatcagcgggcaatcgagtacaaaatgaaaatcagagggtgaagacatgtcgatacaatctttaaaaatcaatctcgcggaatggctgttgcttaaggtcaaatacccgtcccaatttcatttcggaacggcagcggatggggcggggcttacagcggcaagaaaaaagatcattctgacgctgctcccgtcccacgataatctcggcgatcacgccatcgcctacgcaagcaaaacgtttcttgaacgggagtatcccgattttgacattgtcgaggtggatatgaaggatatatacagatccgcaaaagcgctgatcaaaaagcgccaccccgatgatatggtattcatcatcggcggcgggaacatgggggatttgtaccggtatgaggaatggacacgccgctttatcatcaaaacattccgggaatatcggatcgttcagcttccggcgacggctcacttttctgaatcaaaaaagggacggaaggaactgaagcgcgcccgaaaagtgtacaatgcgcatcccgaccttttgttaatggcgagagatgagacgacgtatcaatggatgaagcgtcattttcccggaaaaacagtgctcaaacagcctgacatggtcttatatttggataaaagcgagcggcgcatcccgcgggaagggatctacctctgtttacgggaggataaggagagtgcgctgacggctgaggacagaacgatggtaaaagaagctttggcaaaagagtacggcgagctgcattcctttaccacgacggtcggccggagggtcagccgccatacacgtgaaaaggagctggaagagctttggaatacgctgaaaggcgcggaagccgtcgtcactgacaggcttcacgggatgattttttgtgcgctgacgaaaacgccttgtgtcgtcattcgttcgtttgatcataaagtgatggaaggctatcaatggctgaaaaacataccgaacatgacattgcttgaacgtccagaccctgaagccgtaacggccgccgtaaaccggctgctcagcggcaagcatgaggaaggcggttctttgcgcagtgtttattttgccgggctgcgctcgaaaatcagcggtgatgcccaatgaccgcgccgcttgtgagcgtgatcgtgccgatgtataagacagagccttttatgaaaaaatgcgcggtttctttaacaaaacagacgctgagagacatcgaaatcattttcgtcaatgacggttcaccggatcggtcaggccggattgctgaacaattcgccgcagaagatgcgagaatccgggtgattcataaagaaaacggcggcctcagctcggcccgcaatgccggaataaaagccgcccgcggccgttatatcggttttgtggacggcgatgactatgtgacggaaacgatgttcgagcggctttatgaagaagcggagaagaaccggctggatatcgccggatgcggctattataaggaaacgccgtctaagaaaagaacatatatgccgccgtcccttccgccgggtcgcgtcttcacagcggatgaaatgactgcattgctgacccgtgcgcacgaacatcggtttatttggtatgtgtggcgctatatataccggcgagaatcattgcaagggctgttgttccatgaagatatccggtttgccgaagactctccgtttaatttggcagcgttccgccaagccgcgcgtatcaaagtgatagacgaagggctgtatatctaccgggaaaatccgcaaagtcttacagaaacaccgtttaagccccacttagatcacgaactgcaaaagcaatataaagcgaaaatggctttttatgaggaaaacgggctgacggacgcctgccggagcgatatcaatacatatttgtgcaagcatcagattccgatgctgatcgccaacgcatgcgccgccccgcagccgtcacatcagattacggcgcacatcggcagaatcttaacgtatgacatggtaaaaacggcggtgcgcaggacgccgtgccgccataaacagctgctggcgggggagcgcgtggtgctcggcctgtgcaaaatgcgccttcctcttcttctgcatgcgtttttcgaacggaaatcgaaagagaaaggcagtgcggaaggagcatgaaatttgccattaatttcggcgccaatgtgacggcgtttttactatcggtgtttttatcagtgtggatgacgccctttattgtgaaaacattaggtgtggaggcttttggatttgtccatctgacacagaatatcattaactatttctctattattaccgttgcgctgagctctgtcgttgtgaggtttttctccgtcgccgcccacagggggaacagggatgaggccaatgcgtatgtaagcaattatttagccgcgtctgtcgtgatatctctattactcgctgtgccgctcgccgggactgctttttttattgacaagattatgaatgtgccggccgggctcttaacggatgtgaggctctctatcgtgatcggcagcgtgctgtttatgctgacgttttttatggcggggttcgcaacggggccgttttttgccaacaagctttatatcacaagttccattcaggccgtgcaaatgctggtcagggtgctgtgtgtgctcgctctgtttacgtgcctgccgccgaaaatctggcagatccagctttcggcattagcgggagccgtctgtgcggccgtgctgacttttttcttctttaagaaattgattccgtggttttctttcagccgtaaaaccttgtcattacagacgagcaaagtactgttttcggccggtgcctggagttctgtcaaccagatcggcgtgctgctgtttctgcagattgacctcatgacggccaacctcgttctggggccgtctgaggcgggtgtctatgcggcgattattcaattcccgcttctgctcagaagtcttgcagggacgcttgcttcactgtttgcgccggttttgacttcctattactcaaaaggggatatggaaggtctcctgtcttacgccaataaggctgtgcggatgaacgggcttctgctcgcgcttcccgccgcattattaggagggcttgccgaaccgtttctggcgatttggctgggcccgtcgtttgtgcagacggcgccgcttttatacattcacgccgggtatttggcggtcagtctctctgtcatgccgcttttttacgtatggacggcttttaataaacaaaaaacgcccgccgtcgttactttatgtttaggcggactgaatgtcatattggccgtggttctcagcggaccggcacatctcgggctgtacggcatcaccatcgccggtgcagtctctctcattttgaaaaatgccgtcttcacgccgctgtatgtttcgcatattaccggttttcagaaaaccgcgttttacaaaggaatgttcggcccgttggcggcggccgtatttgcctgggctgtctgccggggtatccggctgttttcaccgcttgacagctgggccggtctgatcgccgcggggcttgccgtatgcatgagctatgccgcattcgcttttttcttcatttgtacgaaagaagaaaggcggcttgctttacagaaatgccgaaaagtgaaaggagctgttcagatttgaaggcgaaacgtgtatttgatatagcggccgcgatgttgttattgtgcggcgcgagcgtcatccttctcttcgccatggcagccgtcagatgcgccatcgggtctccggtattgttcaaacagacgagaccggggcataacgggcgtccgtttacgttgtataaactcagaacgatgacggatgcgcgtgatgaaaacggtgtgctgcttccggatcatctccgtctgaccaaaacgggaaggctgatcagaaaactgagcatcgatgagcttccccagctttttaatgtgctcaaaggagatatcagtcttgtcggcccccgccctttgctgatggattatctgccgctttacacggcggagcaggcgcggcgccacgaggtgaagccggggattacgggctgggcgcagattaacgggagaaacgcgatttcatgggaggaaaaattcaagctcgacgtgtggtacgtcgacaaccgcacatttcttctcgacttaaagattctgcttttaacagtgaaaaaagttctcgtgtcagaaggcatacatcaagccggccatgtgacggcaaaacgcttcacaggcagcggaggtatgtcatcgtgaaaaaggtcgtgctgatcggaaacggcggacacggaaaagtcgtgaaggaaatcgtgcaggcccgttccgatatggagcttgcgggcgtattggatgacgaattcagcggttttgccgttcggaacggtttatatacgggccggacgaaagacgtgcacatgcttcggaaactcgtccccgaggccgtattcacgatatgcatcggccgcaacggcgtcagaaagcagttcgctgaaacgcttgggcttgaagatgacgattatgccgcactcattcaccccggggcgatcgtcagtgaaacggcttccgtcggacacggaacggttgtgatggcgggagccgtcattcaggcgggcgctgacatcggcgcccattgcatcatcaatacgggggcggttgccgatcatgacaatacaatcggagattacgtccatctttcaccgcgcgcggcgcttgccggcggagtgaaagtcggggaaggaacgcacctcggaatcggcgcgtccgtcataccgcagattgacatcggcccttggtccgttatcggcgcgggggctgcggtcatcagccggcttcccggccatgtgacggcggtcggcgttccggcccgcgtcatctcccctatccataacgaaaaaggatgatttcatgcaaacaaacaaacggatttatttgtctccgcctcatatgagcggaaaagaacaggaatacatcgcagaagccttccgttccaattggattgccccgctcggtccgctcgtcaattcgtttgaagcgcggctcgcggaatatgcgggagtgaaaagcgcggcggccgtaagctcgggaacggccgccatccatcttgccctgcggcttgcgggtgtgaaaaaaggagacgttgtattttgtccttcctttacgtttgtcgccacggcgaatccgattgtgtatgagcaggctgagcccgtttttattgattcggaatgggagacgtggaatatgtcgcccgatgcgcttgagcgggcgctgcgggatgcaaagcggcgcggcagactcccgaaagcggtgatcgccgtcaatctttacggccaaagcgcgaaaatggatgaattaatgagcctttgtgacgcatacggcgtgtgtctgattgaagacgctgccgagtccttaggatcaacatataaaggcaggcagagcggcacgttcggccgtttcggcatttattcctttaacggcaacaaaatcattacaacatcgggaggcggcatgctcgtgtctgacgatgaagccgcgattgaaaaagcgaggtttcttgcgtcccaggcgagagatgccgccgttcattaccagcacagcgagctcgggtataactacaggctcagcaacattctcgcgggcgtggggatatcgcagctggaagtgctcgaagatcgcgttcgggcgaggagagaaatctttcacaggtatcgggaagcgctggaaacgtatccgggcatccgcatgatgccggagcttgaaggaacggtttcaaaccgctggctgacggctctgacgcttgataacggcgtgacgccggaagaagccgtcgcctgtcttgcggaacagaacattgaggcccggccgctgtggaaaccgctgcatacgcagccgcttttctcatcttccgtcttttatcctcacagcgaacatgagcgtgtctctgagaaccttttcagccggggcatctgtctgccgtccgggtctgacttgtcttctgaggagcagcagcgtgtcattgacgcacttgcgcaactgtttgaaacgaaaggggagaaaacatggacagccgccatgttatgagccgattaaaagaaacgctgacgggtctgctcagcgttataccgccgcaatctgacatcatatatgccgactatcccctctatggaaatgtaggggatttattgataatgaaagggacggaggcgttttttaaagcgcacggcatccgcgtgaaacagcgctggaatcccgacaattttccattcgggcgccgggcggacaaaaagacgatcatcgtctgtcagggtggcggaaatttcggggatctctatccgtactatcagacgttcagggaaaaaatcgtcaaatcctttccggaaaacaggatcgtcatcctgccgcaatcgatctattatcaggatgagacacggcttgagaagacatcggcgctttttgcggagcacaaggatctccacctgtttacgagagatcatgtgtcatacgaaactgcaaaacacttcttttcggcgaatcatatcgggcttatgcctgacatggcccatcagctgtatccgatggcggcgtcagcggctccgtcacgcggcaggcttcattttatccgcacggatggggaaatcaatccgaagctgcaaaacaattcttccgttaaaagctgcgactggcaggatgtgctgtcagcaagcgaccgcaggggaatcgcttttttccaaacgctgaatgttttgaataaaaaagcgggaaacccgctgccgattgcgcggttttggaaacgctattccgatttcttaacgaagaaagcggtcctgtttttcagcaggtacgaatcggtggaaacgtcaaggcttcacggccacattctgtcctcacttctcgggaaaccgaataccgtcattgataattcatacgggaaaaacgccaactattattacacctggatgcacgaagcgccggatgtccgtctgatcggggaaaccgccggcacgaaggaaaaccttccgctttgaatgagcggaaggtttattttgtttctccgcgttttactttgttgtacgcctcatccaaatgctgaattcttttgagcacaaccgagtttttcgtcagctgatcctgaacaagggttgaaacgacggaacggtaatagctgttcatcgcatgaattcggtcttcattcggattcatttcaatgtgctgtgtaaagttttcaataaaataaggaacagaaaaaagttctgacatctataaagcaactccttttaataagtatatacggtatgaaaccaatcatgtacaatgaaaaaaggggagtgagcatgatggatatcaaacttcagcaaacacaaatgttaaagcctcaattaacgcaagagcttaaacaggctatcacattactcggatacaattccgcggaactggccggatatattgatgagctctcactggaaaaccctctgattgaacgaaaggaaacagacacgccgccactatcttaccataaaacaagtaaaaacaggatgaaagaacgggacggaagccagcagatcagacttacccgcaaaacactgcaggattcgctcaaacagcaagccttagatatgaagctgtccgatgatgagaaaaagattttcaattatctgatacattcattggactcaaacggatatttaaaagaggacataccagctgccgccgaccatgtatccgcttcacaagaggagacggaagcggttctgaaaaagcttcaatcccttgagcccgcgggaatcggcgccaggtctttgcaggaatgcatccttcttcagctccgccgtcttcccgagcggaacgaacaggcggaatggattgccgacgcctattttgagctatttgcaagaaagaactggaaagcgcttacactaaaaacgggcattccgcttaaagacattcaggacatcgctgacatgatcagcgcccttgatccgaggccggggctccgttatgcgcatgaggagccgggtttttacgtggaaccggatattttcatcacggtgaaaaacggcatcattcaagcgcggctcaacagccgttcgtttcctgacatccagcttcatacccattatcagccgctcttgtcagctgccgggtgccgtgacacgaaaaattatctgtcggcaaaatatcaggaatggcgctggctgaaccgggctttgtcgcaaagaaaacaaacgatcacgagaattatcggcgtcctgactgaacggcaggaatccttttttctcacaggaaaaagcggaatgcagccgctgaccttaagagaggtggcggaaacgctggagctccacgaatcaacgatcagccgggccatcaaagggaagtacgttcagacgccgtacggactgtatgaaatgaaaacatttttctcggcgaaagctgaatcgtcgggggacggcggcgcctccaattatgccgtaaaagcgcatctggaggcattggtcggtaaagaagataaaaagaaacctttttcagaccaaaagcttgccgatctgctgcatgaacaatatgacatccgaatctcaaggcgcaccgtcgccaagtaccgtgaccaattaaatattccgccgtcatcggcgagaaaacggtacagctgaaacctccccgagccaaaccccggggaggttctccgtgttacgggatcatccatgaaaacagatgatgctgtaaaaatgtaatgagacagacgagcagaagcaaaaacagactgtgcttaatcgtaaaacggaaaaggtcggcctccttgcccgccagaccgacagcggcacaggcaaccgcaatggattgcggagaaatcatttttccggtgacaccgcccgatgaattggcggcaacggagagaaccgggtccatcccgacagagagcgccgtcaccttttgcaatccgccgaacaatagattggcggacgtatcagagccggtaataaacacgccgagccagccgagcactggcgaaaaaaaggtaaacatcgcgcccgtcatggcaagcgcaagaccgagtgtcgtgctcatgccggaagcattcgtcacataagcaaagccgacaacagaaacaatggtcacgaccggaagcgttaactctttcaccgtttctataaacgcttcgccccatgtcttccacgacatgccgagggcgaacttggagatgacggcggcaatcagaatcgccgtccccgctgaaccgaaaagctcaagtttgtacacggcttcaatcggcgtgccgtccgcctgaagaatctgctgatttacaaatgggacgggaggcgtgaaggtcaatgcacgcccggctgcattcagccaggaaagccacattgacgttccttcataatgaccggttagggcagccttcacgccgggaatcccccagacggatatcatggccgtcagaagaaggaaaggagaccacgctttaaacaccgcggcgcccccgtacttgatcggcgcccggtcagcggccgctgctgattcccgttctgccgcgaaacgaaaggccgttttcggtttccaaaatttcaaaaacagagcgagcgcggccatggaaacaagcgccgacagcacatccggaagctcaggccctaaaaaattcgagcttgcgtactgcacggccgcaaaggagacgccggaaacaagaatggccggccatacctcaaaagcttttttaaacccgctcatcaaaatgattaagtacagcggaataaagacggataaaaacggaagctgccggccgaccatttgagaaatttccattgccggtatcccggtcggaccttcgacggcggtaatcggaatgccgatcgcgccgaaggcaacgggtgccgtattggcaatcaggcaaattcccgccgcatacagcggctgaaaaccaagtccgacgagcaaagcggccgagatcgcgacgggagcgccgaaaccggcggcgccttctaaaaacgccccgaatgaaaaggcgatgagcagcgcctgcaaacgccggtcatctgtaattgagagcaccgaactccggataatctcaaactgtcccgttttcacggtgattttatacagaaagaccgatgtgacgataatccagccgatcggaagcagcccgtacaccgctccctgagaagcggacatcaccgctttttccgccggcatgccgtaaacaaatacagcgattaaaagtgaaacggctaacgttaaaagccccgcgatgtaccccttcatccgtttcaccgcaagcgcccaaaaaaagaagataatcggcacgagcgcgcaagctgccgataaaagcaaatttccccctaaaggagcgtacccctgtgtccattgcatccctaaaaaacccctccttatgtcatgtaagcgattactttttatgataaggtcatctgatgaccgggttaattagcattatattttgaaagttttgaaagtacaatacttttcttgaacaaattgtctgaacctgtcggcggtgcgaaaaaagaagtataatagacgataaacatcaagattcacaagtgacggggtgatcgcgttgaaatataaacaaattaaaacgaaaaaaatctacgaggaagtcgctgacgcattgctggagaagataaaagcgggcgagcttaagccgggtgaaaagcttgattccgttcaggcgctttctgagagttttcaggtcagccgctcggcggtcagagaagcgctgtcggctttgaaagcgatggggctcgtcgacatgaagcagggagaaggcacatacataagagaatttgagccgtctcatgtttcccagccgctttcttccgcccttttgatgaaaaaagaggacgtcaaacagctgctcgaagtcagaaagctgcttgaactcggcgtcgccgccatggccgctgaaaaacgcaccgaagacgatttacaaaaaatccgccaagctctcctggagatgaaagacattgacggagacgaagaattgggcgaaaaagcggatttctcctttcacatggcgctggcagaagcatcacaaaacgggctgctcaagcatctcatgaatcatgtctccgcgctccttttggaaacgatgagagaaacgagaaaaatttggctgttttctaaacgaacgagcgtgcagcgattgtatgaagagcatgaacgcatttacagcgccgtcgccgccaaagacgcggatgaagcggaagccgcgatgacggcgcacctgacgaatgtggaagacgtgctgggggcttattttgaagaaaatgtatagaagctgacttgtgaaaggggataacatcacatgcaggccgaatcttttttttccgaccatgtaaagaaagctctgacaaacgatcctcccggggaatggatgccggcagttccgaaagcgtgcatccccctgcattccggctatcccgatcccgcactcgttcctgacaaggagctgaaagaagccgccgcccgccttctggatgaggagcgcgatctgccgctgcattatatgggaagcccgaggacggccgttttaaaaaagcagattcaagaacggttagccatccgcggcattcactgtcgggacgatgagctgctcgtgacgtcaggcgcctgtcaggcgatagatctggctgcacgtgttttcctcgatgaacaaaccgccgctgccgttgaagctccggtctacatggaagcgctcgagatttttaaaaattacacaccgcatatcatgagcattccgacagatcaagagggcctgcaaacagaaacattagcgttcatgcttgaggaaagaaaacgaaaagggcttctgcttccccgtcttctctacacgatacccgcttttcagaatcctgcgggaaccgtaatgtcagcgaagcggagaacccgcctgcttcagcttgccgaaacgtatgattttctcatcgtggaggatgatgcatacggcgagctcggattcaccgatattccgccgcccttgaaagccatggatcaaaacggccgggtgctgtacgccggttcattatcaaaagtcatcgccccgggtatgaggatcggctggattgcaggggacgccgcattcatcacggcattgtcatggttaaaaaaagacttaggccacccgttttcccaagcggtgactgccgtctatctggaacaaacgaatgttgaaaaacggctcgccgccttgcgggaagcatatcaaagcaaacgtgacgttttgctcgccgcatcagcgcgatatcttccggaatccgcatcctggcacgtgccggaaggcggttactttgtatgggtgaaagcgccgggagcggatacatccgcaatgctggcgagggctctttctcacggcgtttcctatgtccccggtaaatatttttttctgcatcaggaagacggtgcggaatatcttcgcctgtcgttcagttatgccggtaaagccgcgataaaagagggtgtgcaaaaactgggacgtctactggaaaacgggatgtagagcagcttgaggagctttcgggcttctctttttttgtccccttcagcgcatcggacgaaaggatttttcagaaaaaccttccaatccatattcagaatagtgtaggatattcatagagctttcccaaaaacaggtcatcagatgaccggatcacatattgaggatgaaagaggggttcatcatgaaagtctcattatttgtcacgtgccttgtggatatgttccagaccaatgtcggaaaggcgacggttgaggtgctggaacggctcgggtgtgaggtggattttcccgaggggcagatttgctgcgggcagcccgcatacaacagcgggtatgtgacggatgcgaaaaaagcgatgaagcggatgattgccgcgtttgaagaagcggagtacgtcgtcagtccgtcaggttcctgtacgacgatgttccgtgaatatccgcatctgtttcaggacgatccgaagtgggcggcaaaagcgcagcagcttgcggacaaaacatatgagttaacggattttatcgtcaacgttctcggggtggaggatgtcggggcggtgctgcataaaaaagcgacagtccatacatcgtgccacatgacgaggctgctcggcgtgtcggaggagccgatgaagcttttgcgccatgtcaaggggctcgagctgaccgcgcttcccggaaagcaccaatgctgcggattcggaggaacattttctgtgaaaatggctcaaatctctgaacaaatggtggatgagaaggtcgcctgcgtggaagacacggaggccgaagtgctgatcggggcggattgcggctgtctgatgaatatcggcgggcgtcttgaccgtaaggataaaaacgtcagagtcatgcacatcgccgaagtgctgaacagcagataacacgagaaacaacaaggggggaaaatcatggcgatgaaaatcggtaccgccgcttttaaagagcgggtatcagaaggaatagataatgagtttatgagaggagccgtctccggagcgcaggaacggctcaggacaagaaggctgcaggcggccgaagaattgggaaactgggaggattggcgttcacatgcggaagaaatcagacagcatgtgctggacaatcttgatttctatttggaacagctcgccgaaaatgtcgccaacagaggcggacacgtctttttcgccgaaacggcggaagaagcgtcctcctatatccgcgatgtcatccggcagaaaaacgccaaaaaaatcgtgaaatccaaatccatggtgacagaagaaatcaatatgaacgaagtgcttgaggaagagggctgtgaagtcacagaaacggatctcggcgaatacattctccagattgacgatcacgatccgccgtcacatatcgttgctcccgctcttcataaaaacaaagagcagatccgtgacgtgtttaaagagagactcgaatacaaacagacggaaaaaccggaagagctcgtcatgcacgcgcgcagcgttctccggaaaaaatttctcgaagcggatgtcggcattacaggctgcaactttgcgatcgcggataccggatcggtcagtctcgtgacgaacgaaggaaacggccgccttgtgtccgcgctgccgaagacgcagatcaccgtgatgggaatggagcggatcgttccgtcattttctgagtttgaagtgcttgtcagcatgctgacgagaagcgcggtcggccagcggcttacaagttacattacggcgctgacgggacctcggcagcaaggagaagcggacgggcctgaggaattccacctcgtggttgtggacaacgggcgttcccgcatactcggcacggaatttcaatcagtgctgcaatgtatccgctgcgccgcctgcatcaacgtctgtcccgtgtaccggcatgtcggcggacactcgtacgggtccatctattcgggtccgatcggcgccgtcttatcgcctcttctcggcggatatgacgaatacaaggagctcccgtacgcatcttccttatgcgcggcctgtacggaagcatgtcccgttaaaattccgttgcacgagctgctgctcaagcatcggcagaacatcgtggaaaaagagggcaaagcgccgatcagcgaaaaactggcgatgaaagccttcgggctcggctcgtcatccccgtccctttataaaatgggatcgaaatgggcgcctgccgccatgacgccgtttacggaagatgacaaaatatcaaaagggccggggccgttaaaagaatggacggcaatacgggacttcccggcgccgcataaatcgagattcagagattggtttaaagaccgggaaaaacaaaagggggaagaatgatgatgaaagggacggttacacatcaggaatcctttttaaaccggatcgccgaaagtctgggcagagagcgcaggaaatcaggcgtgtccctgcctgaatggaagtatcagcctcaatatcaaacgcatgcgggctgtacggaagacgatcttgtcacgatgctgaaagaccactgcgtcaacattcataccgaactgatcgaaacggatgcagccgggctttacgacgctttgcgcacgcaggtgaaccgctttgaaggagggcctgtcatcattccgaaggacagccggtttgaaacgtacggcttgcagacccttatgacagaagagtggccggatgaaggggttcccgtttgggaatgggacgcggaacaaggagcgaaaaatattgaaaaagcggaacaagcgaatgtgggcatcacattcagcgagatcacgcttgcggaatcagccaccgttgttttgtatgcgtcagagcatgccggccgttctgtcagcctgcttccgaccacctatatcgcaatcatcccgaaatcttccattgtgccgagaatgacacaggccagcgatatactgaaacagcagatcagagacggcgtcaccgttccttcctgcatcaactatattactggaccgagcaactcggccgatatcgaaatggatttggttgtcggcgtccacggacccgttaaagccgcttatatcctcgtgaatgaccgataaaaaaacaacccccggtttgcggccggggtttgtttttatataaacgcgttaatgatcatgataaaacagattgcactgacagaaataatcgtttccatcgccgtccatgtcaggaacgtttcttttaccgtcattccgaaatactctttaatgagccagaaaccggagtcattgacatgtgacagaatcaaagagcccgctcccgttgccaaaacgagaagctcactgctgacgcccggcatgacagatgcaatcggtgcaacaatgccggccgccgtcatcatggcgacagtcgctgaacctgtggcgacacggatgaccgccgcgatcgtccagcttaaaagaacgggagagaagcttgagtgtttcgccatgtcagcgatatacgtgccgacgcctgaatcaatcaggacgttgttaaaagcgccgccggctccgatcacaagcagaatggaagcaatcggtcccagacagtcattgctgaattttaaaatgctttctctgtcaaagccctgataaaaaccaaggctgaaaaaggagtaaaccgtggcgatcaaaagcgccgtgacagggtcgccgataaatttaaaagtttcatagagcgtgcttttttccggaagcgcaatttcggcaagcgttgccataagcatcaggatcaccggtaccaatatcgtaaacaatgtatttgcgaatcccggaagcttgcgtttttcattccgttcaataaattgttttttcaacagttcgggaacgggtttatgaatgcgcttaccaatccattttccgtaaagcggccccgcgatgatggcagtcggaatcccaacgattaaagaaaacaaaatcgtttttccgacattggcgtgataaatgccgacagccgccatcgccgccgggtggggcggaaccaatccgtgcacgacggaaagtcccgcaaggagcggaattccgatcgtcactaatgaaaccccggtttcaatcgcaatcgtaaacaaaagcggcacgagcaggacgaagccgacctggaaaaagaccgggatgccgacaataaaagcgacggccatcatcgcccaatgcactttctttttgccgaagcggccgatcagggtgtgggcgatacgctccgcaccgcctgattcagccatcatttttccgagcatcgtaccgagggccagcacgatcgcaagcagcgacagcgtattgccgagcccggttttcatcgaagcgataatgtccggcagattcatgcccgttgcgaaaccgacaaggatggatgtaatcaaaagactgataaacggatttaatttagcgaccgtaatcaataagagtaaaacgataatagcggcaatgacaataaacagtaacatgaccttttcaccctttcaaagaagaattaacggctttgtttgagctgaaattcactgatgacgtcaaattcatctttgagcttgtcatacagccgctcgtataagtaaaacagctcaatatatgtttcgctgtttttgacgttcggttcatggcggtgagaaattctgatccagtcctgaacatcctcgatccgttccatttcgccaaggctgtgcaaagcgagaacggccgctccgagcgccgaggcttcgtaactttccggaacgaggacttcccgtcccatcgtatcggacaaaatctgcctccacagcggcgatctcgcaaatcctcccgaagcccgcacgtcttttgcggggcccgccaaatctctcagtgcgacaccgattgaaaagacgctcatgatgacgccttccagcaccgctctgataaaatgctcccgtttatggcggaggctgatgccgaaaaacgttccgcgggcattcggattccaaaacggcgcgcgctcccctgataaaaacggcagaaacagcaatccctcagagcctgcgggcactttatcagcgatatcaatcattaaatcatacggatcaatgccgagccgcttcgccgtttcgacttccggagaagcgaattcgtctcgaagccagcgcagcataatgcctccgttattcgtcgggcctccgatgacccaatgcttgtcagtcagcgcgtaacagaatgtccgcgctttttcatccgtaatcggcgcatccgtcaccgaacgcacggctccgcttgttccgatcgtaacggccacttcgcctttgccgatcgcgccgactccaaggttggcgagcacgccgtcattggcgccgataataaacggtgtatccgcatgaatgcccatccgtgcagcgatttccggcgcaaggccgcgcagctgatgagtggtcggcacgatgtccgacagctgatcttcccggattccggcaatccggagcgcttcttcatcccaggaaagcgtatctaaacggaacagccccgttgccgaagcgatcgaataatcgacgacataagttccgaaaaactcgtgcagaatatattctttaatactgatgaatttggcggttttcgcgaatgtctccttgtcctgttctttcatccacacaattttggaaagcggagacatcgggtgaatcggcgtacccgttcttttataaatatcaaaaccgttcatctcttttaaaatacgttttgattgctcggcgctgcggttgtccgcccaaatgatgcttttggtcagcaggccgccgttttgatcgacagctatcaatgagtgcatggcggtgctgatgccgattgcaagcagattgtcagggctcagtccggcctttgtgacggcgcctctgatgcttccgataaccgcttccagaatgtgctcaggatcctgctcggcccatgccggctttggctgtattaaatcatagtgaaccgaatgcttggctaacactttgcctcttggtccgaacagaacggctttcgtactggtcgtgccgatatccagaccgataacagcttgggtttccttcataatatatcccgcctaatctgattgaataataagatagattgataatgtatgcccttacaaagtcaattataggaataatttttttataaatcaacgatgaagaagaaaatttttttcataaaattgcctcaattcccgctgtatcggcattctctcttttgaaaaataaatattacaaacgtttgtgcgcgatcatttttctgatttgctgcaagttggcgagcgttttctcctgccgcagccgggccgtggcgaaatacagtgtatcaatgaccgacagctgggcaagccttgcggacattgcttccgttctgaaagccgtctcccttgttgatgtatacagcaccacgtcggaaatctgggtgagcggcgacttttggtagcttgtaatgccgatcgtgccggcgccgagcgatttggccgttttcaccgcgtcgagcacgtccttgttgcttcccgaatgagaaataccgatgactgcgctttcaggaccgagaagacccgctgacatcgcctgaaagtgagaatccgtgtgcgcgatgcaatttatacccgtacgcataaatttatgatacgcgtctatggcgatcagcccggaaccgccgtttccgtaaaattcgattctgtctgcgcggtgaatcatttctaccgctttttcaacgtcggccgggtctaataaatgaaaggtatcggtcagaccggaaatgtttgtgcggaaaactttccggatgatgacttcgatatcgtcgtcggggctcatttcttcatgaatgtgctgcaccggctcctgaacgatctcctgagccagcgtgatttttaaatcctgatagccggaaaaaccgagccgtttgcacagcctgaaaatcgtcgcttcagagcttttcgttttttccgccagctgaatgatggaaaggtgaaccacgtctttcggttccttcacgatatggtctgcaatcgctctcaattttggcgacaaacctttgctggccgcctgaatcttcccgatgctgcttgaattcacaggggtcatgctataacctccctactcgaatgtaaacgcatacttttatgataaagcaagtttcaatataaggaaaacagaattttaaaattgttttttcaatttggcgtataaaaaaagagaaaaagccgccgatgatagaaagtgaggaggcatctggatgaaaaaagcatggattctcgtcatatcattcggcattgcgcttgcgctgtttttatacgcaaacacaaaggtgaaagcggaaagcgcggcgcccggaaagcaaagccttgtgtccggatttcagctgagactttcgaatgaccgggaaggacaatagacggcaaaaattagtattgactttgaaaatagaagactgtatattatgttactatattcagaaaataaaaactcaaaagattcatttaacataaaacactgtgaacgggagcagtaaaagaatccaatcagaaaaagagagccgcgggttggtgcaacgcggactgattgttctttgaactcgcccggaagtggcagggcggaacggaattatcggaatattccctatgtcctaacggctgaccttcgttaaaaggtttttaagctggattccggatattcgggatcaacaagagtggtaccgcggctgcctgaggcacgccgtctcttttcccaaagaggcggcgtgcttttttatgtgatgaacactttttgcgagagggcgtgtgatagatggaaaaggacaagcaaacgttaaaacggacgatgtcgtccagacacattatgatgatggcgcttggaggcgcaatcggggccgggctctttaaaggcagcagcacggcgattgatgaagcggggccgtccgtgctgctggcctacctcctcggcggaatcattctgctgtttattatgcaggggctggccgaaatggctgtcagaaacaaacatgcaaggacgttccgtgatttggttcagcagtctctcgggtcgtacgctgcatactttttagactggatctattggaaaatgtgggtgctcaatattgccgctgaggcggtcgtagccgccattttcattcaatattggctgccggaatgtccgatatggatattggctttgatcatttccattgtggtgacggtcgtaaacatgctttctgtgaaactgtttgccgagacggagtactggctcgcgctcattaaaattacagtgattgtcatctttattttatgcgggattctgctattatttttctcattcggcaatcacacggcgccggggctgtctcatttaacggatcacggagggtttttcccgcatggagcggggggcgtcattacggcgatgctcgtcgtgatctactcatacggaggaacggaaatcatcggcgtcacgctggcggagacaaaaaaccccgaaaaggtgatcccgaaagctgtccgtagcacgttaacgcggattgtcgctttttacttgctgccgtttttcatcatcgtcagcctgattccttggaatcaagtcaacagcgttcccgaaagcccgtttgtcatagtatttaagatgatcggaattccgggtgccgaccatattatgaatgccgtcattcttcttgcgattatctcgtctatgaactcgggactgtacggatcatcccgcgtcttgtttacgcaggcttctgacggccggctgccgaaaatcttttcaaaactatcgaagaaaaaggttcccgtctatgcgattctgacttgtacgtcatttttatatgtaggcgtcctgatttctttattcgcgggaagccagacgtttaattatttgatgggttccctcggctataccgtgctgttcatctggctgattatcggattcgcccatttgaaatcaagaaaacattcaacagaacagccggcttattacgtcaaatggttcccgtacacgacatggtttgcggtgcttgcgcttttggccatcctgatcggcgtaattgcgacgacatccatcgtcatcacatgcatcactgcggccatctatctcctcattacggctgcgtatctcgtgaaagggagacgtcaataaataaaaaactcttgccccgcggcaagagtttttttaatgaacggcctttttttctgcggccagagcaggtgttttcagtttctttggtgttatattcacaaaacaaatgcttgtgacgatcagaagcagtccggctaaaaggctgacggtcagcggctcatgcaggaatatcgagctgacgacaatggatatgagcgggatcaggaaggtgtaagaggcaaccttgcttgcttcccctgaaccgacaagcgtaaaaaaggcgagccagccgagcgcgataacaaaaactgaaatgaacagaaggctgagaatgaacggagctttccattgaatcgctgaaaagctttctgaaaaatggccggagctgacaagcagcacgccgccgatcagaagctgaagagcgaccatccagatagagtccgcgcgtccgcccgttcttttcacatataccgtgccgagcgcccagctgaccgcggagcctaaggccaaaagaatgccggcgatggaaatatggcctccgaaaccggctgcgctgatgacggcgacaccggcaaagcccagaataagaccggctatttttaaaggatacatcgattccccgagccacagccaagaaaaaacgcccattaaaaccggctggaaaaacacgatggctgaaaataagccggcaggcaggtaattcaagccgaccgtttgcaggccgtaaaataaagtaatatttaaaatggcagaaataagatagatcggccacgtttctttaaaacgcagctttttaaaacggggcagcgccaccattaataatagaagtccgccgatcagcgtgcggattccggcaaacagaagaggcggcgaataggcaagcgcggcctttgtcagcggccagttaattccccacaccgtgactagaaacgccagcataagagccgtctgtattttcgaaagctgtttcacgtcgttcactccttgtagaacaattccatcatatgatacggtaatcagtaagataaataaaatgaatcttttttataaggagcataagtaaaacgttatgacgattacacaactgcgggtttttgttcaaatcgctgaaacgggaagctttacaaaagcggggcaggcgctgaatatgacgcagcccgctgtcagccatgccatctctgcgcttgagtcagagctcggcatcaagctgatcatccgcgagcgccgcaacggcgtaaggctcacggacacgggcggaaaaattctcgtccatatcagagaggtgctcaaaggcatagaaaaagccgagcagctggcggccgcggaaagagggcttgaacagggaacgattcacatcggcacatttccggccgcttccgcttatttcattccaaagctgatcagcgtgtttaaaaaacggtatccgaagcttgagttggtgcttcatgaaggaacggttaacgaagtaaaggaatggctccgctcccgggtaatagatgtgggtatcactctttttcctacggaagacatggaatatctgccgctgaaaaaagataaaatggcagtcgtgcttagaaatgatcatccgctttgcagctgtgagtcaatcactctgaaagatcttgaccgccagccgatgatcatctgtgacggaggatacgaatcaccgtttattgatatgtttaaggaggcaggatctgtgctgactgccgcattcactgtttacaacgtcaatacgtccatcagcatgatcaaagaggggctgggaattgcgatattatcacaaatgtctatgtcgggaatatcgctgccggaaaatgtcgtgacaagagaactcaatcgtgcggtgtaccgagatgttctgcttgccgttccgtccgtaaaggaggcttcattggcggcaaaactttttattcaaatcgcacaggaactcacaaagaacgaataaaaaaagaccctaataatcatagggccctgaatcttatcggttaattttaaaagaatttgtcgtattgacaagttttgaaccgctgaacgtggctttgacacgataataacctgtcttgcatccttttaaagagaatgacttagtcacccttactgagaaagaaaaggttgtttttttacaagtcgtccatttctttccggactttcgctgtaagtataggtttcctttaaaagttcgatctgacggatacgctgtactgagagtaaaatcgacacttttcgcttttttcgtgtagtaggaggcatcggtaaatccgcttacatttaaatgctgctgagtgccggagtaaaagtctgcggcatatgccttatcggtgtttcctgtaaagaagattgctgccagtaaagctgttgtgagtgccattaagatttttttacgcatatagacaatgacttccttcctattcaatatcatacatatcttaacattattgggtttgttctttcaacgatagattttcacttttataggatgaaaagctcatcatatctgaatgtaatagattcattcatacagagttcactagtgacgaccgctgactgattgttcgaagatcatcgaatcaaattgtttaactcacgggaaaagctgtggtaaggtgtgtggtagagaccttgtttaagatctgcttacactaaaccgcaaaggagaaaacgatggctgaacatacattgaaagatactgcgttttccgtattgaatttatcgccggtcgtacaggggggaacggttgctgaatcgttccgcaacagcatggatttagcgcgccgcgccgaggagtggggctataaccgctattggcttgcggagcatcataatatagaaggagttgccagctcggcaacggcggtgctgatcggccacatcgccggcggcacgaaaaaaatccgcgtcggttctgggggtattatgctgccgaatcattcttcacttgtgatcgcggagcaattcggaacccttgaaacgttatatccggggcggattgacctggggctcggacgcgcgccggggaccgaccaattaacggccagagccttacgaagaaacataaacagcggggaagattttccggagcagcttgaagaattgagaaattacttcaaaccgacaggcaatgtgcgcaatcaagtccgcgccattccgggcgaagggctggacgtgccgatctggcttctgggctcaagcggattcagcgcgcgtcttgcgggagagctcgggcttccgttcgcctttgcggctcacttttcaccgaaaaacaccgtgcccgcccttgagctgtaccgcagctccttccgtccgtcagacgtactggatcaaccgtacgcgatggtcggcgtcaccgtcattgccgccgatacggacgaaaaggcggagcatctggcaacatcgcattatcaaagatttttagacctcgtccgcggcacgccgaaccagctgaagcctcctgttgaagacatggatcaaatctggtcgccgtatgaaaaagcgatggtcaatgaacagctcagttcaacgatcgtcggcggaccggagcgtgtgaaggaaaagctggaaagcttcatccggacaacacaggcggatgaaatcatggtgaattcagaaagctttgagcatgccgacagaatgagatcatttgagatcatcgccgaattaaaaaacagctgagcaaaaaaagcaatgtgccgcgcacattgctttttttattcgccgatccgcctgactgaattccggatgacgagttccggttcatacacgacgtcatccttcttcggttttttatgctctaagcagtcgatgacgtattttgccgccgctttccccataatggatttcggatgcttgacagaggtgagcttcacctcggaaatctgggcgaaatgtgaatcgtcatagcccatgaccgatacgtcatcaggcacctttaacccgaattccctgagaagattaatcgtcttcagcgcaatttcgtcattgtagcaaagaatggccgtcgggtgtgatccgctgttttgctcaagggtatgcttaattttttggagaagcacggtttctttttcttcagtcgtgtaagtgacgatcatgtccggagacgggaaaatcccgcgctcccgatgcgcctgcagatagccgttcatccgtttgacgccctgcgtgtcatccgctttaaagattcccataatgtgcgtgtggccgagggacatgacgtattcgcaagccatcatgccgcctttgacatcattgacggaaaagcttggtgcggccagctccgcataagaggcgttaatcatggcaaacggaatgccgtttttctccagattgagatagtagccgatgttgggcgtctgcagcgcgcttttcgtaggctcgacaatcagcccgtctatatttttggacagcaggttttcaagaccgcgccgttcactttctgtattgttgttggtgctcgtcagcagcatggaatagccctgttcgcttaaataagattcgattcccctgatgatgctcggaaaaatatagtctgatatgtacgttgtaatgacgccgatcgttttgtttgaatgcatggctgatttcgccgtgcgtgaagcgacaaaggtgcctccgccctgaacgctgtacagcagcccctgcgagaccaaatctccgatcgcctttctgatggtatggcggctgacgccgaactgctgcatcagctcattttccgtaggcagcttttcgtccggctgtatttttccttgattcagccatgaacaaatttcttcttttacttgagcatatttcggtagcatatcaattcctccaaaatgtatacggacaaattccagtataacatagtaagccctttcatcaagctgtaaaaataattgacagattatgaaaaactgcttattctttatttgtacgtactaatttcccttatttttagataaaattctttataagtacgtacaaatgtggcggttctgaagaaaacaaagcaacatcaagcgccgcactcagatttgtaagcgtttttattctattattcgcgggagggtaaaattcatgaagaatcacccggcaccaattggctcaaatgttcctgtcactcggcagcattccaagtggtttgtcattctcatctcatgcgcggccggactgggagggcttttgtacggttatgacacggcggtgatttccggcgccatcggtttcctgaaagatttgtaccgcttaagtccttttatggaagggctcgtgatttcaagcattatgatcggcggtgttttcggcgtcgggatttccggatttttgagtgaccgtttcggacggagaaagattttgatggcagcggcgctgttgtttgcggtgtcagcggttgtctctgcgctttctcaaagtgtgtcttccttagtgatcgccagagtcatcggcggtctgggaatcggcatgggctcctcgctttctgtcacgtatattaccgaagccgctccgccggccatacgcggcagtctgtcttcactgtatcagctgtttacgatattagggatatccggcacttattttattaacctcgccgtccagcagtccggctcgtatgaatggggagtgcacaccggctggcggtggatgctcgcttacggcatgattccgtccgtcatcttttttatcgtgctgcttatcgtgccggaaagtccgcgctggcttgcgaaagcggggcgccgaaatgaagccctcgccgtgctgacgcgcattaacggcgagcagaccgcgaaagaagaaatcaaacaaatcgaaacgtctttacaattagaaaaaatgggttcattgtctcagctgtttaagccggggctgagaaaagcgcttgtgatcgggattctgctggctttattcaatcaggtcatcggcatgaacgcaattacgtattacgggccggaaattttcaaaatgatgggtttcggacagaatgcggggtttatcacgacatgcatcgtcggtgtcgttgaagtgattttcaccattatcgcggttcttttagtcgataaggtaggccggaaaaagctgatgggggtcggatctgcctttatggcgctgttcatgatcttaatcggggcatccttttattttcagctggcgagcggtccggctttagtcgtcatcatattgggattcgtcgccgctttctgcgtatcagtcgggccgattacatggatcatgatttcggagatctttccgaaccacctccgcgcacgcgccgccggtattgcgacgatattcttatggggggccaactgggcgatcggccagttcgtgccgatgatgatcagcgggttagggctcgcgtacaccttctggatattcgccgtcattaatattctctgtttcttgtttgtcgtgacgatctgccctgagacgaaaaataaatcattagaagaaatagaaaaactctggataaaatgaaagcgttttacgacaaaagtccgctccggcgggcttttgtctgtcaccttcattccgtttctgtatataatgactgtatcaaggagatactggaaaatcctgcgaagaatgtcgaggaattgacctttaacagttgaattaacaatgtcatcctgttaaaataattaaagaaagcagacataattttttttggctatgatgggacgttttttgtcatagcgggacattttctgtccagtatgaataggaaggaacgtttgagtcatgaaccagttaatacaagctcaaaaaaaattattgcctgatcttttgcttgtgatgcagaaaagatttgaaatcttgcagtatatcaggcttaccgaaccgatcggccgcagaagtcttgctgccagtctcggattgaccgagcgcgttctcagaagcgaggttcagtttttgaaagaacagaatctcatcgatattaaaacaaacggcatgacaatgacggaagagggctattcactgctttcgattctggaagatacgatgaaggatgttttaggattgacgcttctggaaaagacattaaaagagcggcttaatctgaaagacgccattatcgtttccggagacagcgaccaatctccttgggtcaaaaaagaattagggagagcggccgttgcatgtatgaaaaagagattttcaggcaaaaatatcgtcgctgtaaccggcggtacgacaattgaagccgtcgccgatatgatgacgccggattcaaaaaaccgcgaactcctgtttgtgcccgcaagaggcggtttaggcgaagatgtgaaaaaccaggcgaacaccatatgcgcgcatatggcggaaaaggcttcaggcacttaccggcttttgttcgttcccgggcagctgtcacaaggcgcctactcatctattattgaagagccttccgtaaaagaggtgcttcacacgattaaatcagcgagtatgctcgttcacggaatcggcgaagctagaacaatggcggagcgaagaaacacgcctttggaagatttgaagaaaatagatgacaatcatgcggtgacagaggcattcggctactactttaatgcggacggagaagtcgttcacaaggtgcattcagtcggaatgcagcttgatgacctcgatgccattcccgacattatcgcggtagcgggcggatcatcaaaagcagaagcaatcgaagcttattttaaaaagcagcgaaacacggttctcgtcacggacgaaggagccgcaaagaagttattaagggataacagtccctcaatataaatatctctcacttatttaaaggaggaaataatcatggcagtaaaagtcggtattaacggttttggtcgtattggacgtaacgtattccgcgcagcattaaacaatcctgaagttgaggtagtagcggttaacgatttaacagacgctaacatgcttgctcatcttttacaatatgattccgtacacggaaaattagatgcagaagttaaagttgacggcagcaaccttgttgttaacggcaaaacaatcgaagtttctgctgagcgcgatcctgcgaaactcagctggggcaaacaaggcgttgaaatcgtagttgaatctactggtttcttcacaaaacgcgcagacgctgcgaaacacttagaagcaggcgcgaaaaaagttatcatctctgcacctgctaacgaagaagatatcacaatcgttatgggtgttaacgaagacaaatacgatgcggctaaccaccatgttatctctaacgcatcttgcacaacaaactgccttgcgccgtttgcaaaagtacttaacgacaaattcggcatcaaacgcggtatgatgacaactgttcactcttacacaaacgatcagcaaattcttgatcttccgcacaaagactaccgtcgtgcgcgtgcagcagctgaaaacatcattcctacatcaactggtgctgctaaagcagtttcccttgttcttcctgaactgaaaggcaaactgaacggcggagctatgcgtgtgccgactccaaacgtttctcttgttgacctagttgctgaactgaacaaagacgtaacggctgaagacgtaaacgcagctcttaaagaagcggctgaaggcgatcttaaaggaatccttggctacagcgaagagccattagtatccggagactacaacggcaatgctaactcttctacaatcgatgctctttctacaatggttatggaaggcagcatggtaaaagtaatctcttggtacgataacgaaagcggctactctaaccgcgttgttgaccttgcagcttacatcgcaaaacaaggtctttaattcatagctcccggaaagggccggacttggttctttcggacagaaacgctataatgaaagcggacaagggaaggggacggactccctttccctttttccatgagaaccggctttcagaaagcgccggattgctgcagaacgtccgcgttttgaagtttccgcggcactttcgttttctgagccgcctgccctggctcagaagacgatctgccccgtgcccggaagctgcaatctgccccgcggcggaagcatcatgaggcggtttcacgtttcacgtttttcgtgctatgcaaaccattttgaaggaggatctcctaaggcatgaataaaaaaacagtaaaagacatcgacgtaaaaggcaaagtcgtattctgccgcgttgactttaacgttccaatgaaagacggggaagtaacagacgatactcgtatccgcgctgcgcttccaacaatcaaacaccttgcagaccaaggcgcgaaagtccttcttgcgagccacttaggccgcccgaaaggcgaagtggttgaggagcttcgtttaactcctgtcgctgcacgcttaggcgaactgctcggcaaagaagtgaaaaaagcggatgaagcttacggcgatgctgtaaaagcacaaatttctgatatgaaggacggagacgttcttgtattggaaaacgtacgtttctaccctggtgaagagaaaaacgatcctgagcttgctaaagcatttgctgagcttgcggatgtatatgtcaatgacgcattcggtgctgcccaccgtgctcacgcatctacagccggaattgccgagcatctgccggcggttgcaggattcctgatggaaaaagagcttgacgttctcggcaaagccgtgacaaatcctgagcgcccgtttacggcaatcatcggcggcgcgaaagtaaaagacaaaatcggcgtaatcgaaagtctgcttgataaagtggacaacttgatcatcggcggaggtcttgcttacacattcgtaaaagcgcttggttatgaagtcggtaaatctcttcttgaagaagataaaatcgaacttgcaaaatcattcatggaccgcgcgaaagaaaaaggcgttaaattctatatgccggaagacgttctcgttgctgatgatttctctaacgatgcaaacgtccaaatcgtgccgatctctgagatcccaagtgatttagaagcgatcgacatcggaacgaaaacccgcgaaacgtacgctgaagttatcaaaaacagcaaacttgtcgtatggaacggaccgatgggcgtattcgaaatcgacttgttcgctcaaggcacaaaagcagtggctgaagcattggcagaggcaaacgatacatactctgtcatcggcggaggagactctgcggcagccgttgaaaaattcggccttgctgacaaaatgagccatatctcaacaggcggcggcgcatcccttgaattcatggaaggcaaagagcttccaggtgtagctgcgctgaacgataaataaaaactgctataaggaagtggaacagatgagaaaaccaattatagccggtaactggaaaatgaacaaaacactcggcgaggctgtcagcttcgttgaagaagtgaaatcttccattccagcagcagacaaagcggaagccgttgtttgcgcaccagctcttttcttagaaaagctgacttctgctgttaaaggaactgacctgaaagtcggcgcccaaaacatgcattttgaagaaaacggtgcgttcacaggtgaaatcagcccggtcgctctgaaagaccttggcgtggattactgcgtcatcggccactctgagcgccgtgaaatgttcgctgaaactgatgaaacagttaacaaaaaagcgcatgccgctttcaaacacggcattgtgccgatcatttgcgtaggtgaaacgcttgaagagcgcgaagccggaaaaacaaatgatcttgttgccgatcaagtgaaaaaaggtcttgcgggtctttctgaagagcaagttgccgcttccgttattgcgtacgagccaatctgggcaatcggaacaggcaaatcttctacagcgaaagatgctaacgacgtctgcgcgcatatccgtaaagtcgttgctgaaagcttcagccaggaaactgctgacaagctccgcattcaatacggcggcagcgtaaaacctgcaaatattaaagaatatatggcagagtccgatattgacggtgctttggtcggcggcgcaagccttgaaccgcagtcattcgttcaattattggaggaaggtcaatatgagtaaaaaaccagctgcactcatcattcttgatgggttcggattacgcaatgaaacagtcggaaacgcagtcgcacaagcgaaaaaaccgaatttcgaccgttattggaaccaataccctcatcagacgctgacggcatcaggcgaagcagtcggactgcctgaaggacagatggggaactctgaagtcggtcatttgaatatcggcgcaggacgtattgtgtaccaaagcttaacacgcgtgaacgttgccatccgcgaaggcgaattcgaacgcaatcaaacgttccttgacgccatcaaaaacgcgaaagacaacgacaaagcgctgcacctgttcggccttctttctgacggaggcgtacacagtcatatcaatcatttattcgcgctgctgaagcttgcgaaaagtgaaggactgacgaaggtgtatattcacggtttcctcgacggccgcgatgtaggtccgcaaacagcgaaaacttacattcagcagctgaatgagcaaatcgaagaaatcggtgtcggcgaaatcgccagcatttccggacgctactattccatggaccgcgacaaacgctgggaccgtgtggaaaaagcgtaccgcgcaatggcttacggcgaaggcccgtcttaccgcagcgcgatggatgtagtcgacgattcttatgcgaacggcattcatgatgaattcgtcattccgtccgtcatcacaaaagaaaacggtgaacccgttgcgaaaattcatgacggcgattctgtgattttctataatttcagaccagaccgcgccatccagatttcaaacacgtttaccaacaaagatttccgcgatttcgaccgcggtgaaaatcatccgaaaaacctgtatttcgtctgcctgactcacttcagtgaatctgttgacggatatgtggcttttaaaccggtaaaccttgacaatacggtcggtgaagtattggcacagcacgggttaaaacagcttcgcattgcagaaactgaaaagtatccgcacgttacgttctttatgagcggcggccgcgaagaagaattcccgggcgaagagcgcatcctcattaactcgccgaaggtcgcgacatatgacctgaagcctgaaatgagcgcgtatgaagtgaaggatgctcttgtaaaagaaatcgcggctgacaagcacgacgcgatcatcctgaactttgcaaaccctgacatggtcggccactccggaatggtcgaaccgacgattaaagcaattgaagcagtggacgaatgcttaggcgaagtggttgacgccatcatcgctaaaggcggacatgccatcattaccgctgatcacggtaatgcggacattctgattacagaaacaggcgaaccgcacactgcccatacgacaaacccagtccctgtcattgtgacgaaagaaggcgtgacgctgcgcgaaggcggaatcctaggcgacctcgcaccaacgttattagaccttctcggtgttgaaaaaccgaaagaaatgaccggaacatctttaattcaaaaataagcgtaaatcaaaaggagagacaaactcatgccatacattgttgatgtttatgcacgcgaagtccttgactcccgcggcaacccaacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaactgctgttaacaacgtaaacgaaatcatttctccagagcttctcggctttgacgtaactgaacaaaacgcaatcgatcagcttttaatcgagcttgacggaactgaaaacaaaggcaaactcggtgcgaacgcaatccttggcgtatctatggcttgtgcgcgcgcagctgctgatttcttacagattcctctttaccaataccttggaggattcaactcaaaaacgcttcctgtaccgatgatgaacatcgtaaacggcggagagcatgctgacaacaacgtagacattcaagaattcatgatcatgcctgtaggcgcgcctaacttccgtgaagcgcttcgcatgggcgctcaaatcttccacagcctgaaatcagttctttctgctaaaggaatgaacacagctgtaggtgacgaaggcggattcgctccgaaccttggttctaacgaagaagcgcttcaaacaatcgttgaagcgatcgaaaaagccggcttcaaacctggcgaagaagtgaaacttgcgatggatgctgcatcttctgagttctacaacaaagaagacggcaaataccatctgtctggcgaaggcgttgtgaaaacatctgctgaaatggttgactggtacgaagaaatggtttctaaatacccaatcatctctatcgaagacggacttgacgagaacgactgggaaggccacaaacttcttacagagcgtcttggcaaaaaagttcagcttgtcggagacgaccttttcgttacaaacacgaaaaagcttgctgaaggtatcaaaaacggcgtaggcaactctatcctgatcaaagtaaaccaaatcggtacattgactgaaacgttcgatgcgatcgaaatggcgaaacgcgcgggctacactgccgttatctctcaccgttcaggtgaaactgaagacagcacaatcgctgacatcgctgtggcaactaatgcaggacaaatcaaaacaggtgctccgtcccgtacggaccgtgttgcgaaatacaaccagcttcttcgcatcgaagatcagttggctgaaactgctcaataccacggtatcaactctttctataacttgaataagtaatggaatggacgccgggagatattctcccggcgtttttttatgctcccgggcttttccctcctttttcatcattttcatttggtcaataatattcatttttcccctttttaaaggaatcagtgttcttcaatcgaaagggaagaggtgttaataagaggagggattatgatgaaattttcatttatgtcagccgcggtggcagcaagcgtcatatggggcgcgtctgccgggccgctgtccgaaactcatgcttattcagccgtgaccgcgccggtttttgatgctgatgaggcattggacacgatgcatgatctgagtgaaaccatcggaccgcgggaaaccggaactgcgaaagaaaaggaagcggctgaatacatatcgaatcgcctgcgggctcagggcgtcagtgtcaaagtacagtcatttccattgaaaaagtacttttcaggttcagtcacagcgggagatcatgaatttccgctccgctccgctgatcaatccgctgttgaaaaagagctgagaattgagggagggatttttgacggcggctgcggatcacgcgatgacgtaacaggagccaaaggaaagattgcagtgatacgcgaaggaaagatccccgtttctcaaaagatcaaacatgccgaacaagcgggagccaaagcagtcattatttataatcagacaacaaaaccgctcgccgtccgtccgcataccgataaaggaatcacaataccggcggcgggtatgaaaaaagaagacggtgaagcattgctgaaggaaaagcaggcagtcattcaatttaaaaactataaaaaccgcacctcacaaaatattataggaacgcgcaaagcagcacaggccaactcttctgatgctgatattatttatgtcacagcgcattatgacagcgtaaaaggcgcacccggagcggatgacaacgcctcaggcacatctgccgttctggaaatcagcaagcaactcaaacacataccgaaagacaaagagatccgctttatcctgttcggtgcagaagaattatggtctgcgggttcatcttattacgtcagtacactcacgaacaatgaaagaaagcacagccaggccaattttaatgccgatatgattgcgactgactgggaagaagcgagtcaaatgtgtgtcacgactcctgacggcaaggaaaacccgagcgtccggtatgctgaaaaagccgctgaaaaatcccgcttggtcaagccaaacctgattcagctcggttactcagaccatgtctctttttatgaagcagggattccgtcggctaactggatttggctcagccccgatacacaggagccggggccttggtatcacaccgagaatgataatatgaaacacatcagcaaagaacgattagagaaagcgggagcactcgtttccgcggctgtaactgaggcagtgaaagaataaaagacaggcttcggcctgtttttttatattgttttctgtatattctctcaattgagggagattttctcactcgttaccagatatataccatttgacaggattttattttacaaataaaagaaaaataaatagataatacctaatttataaaaggatgtaaaactcatttatcaaattttaacttttgttataattgcgatatcgatcgatatttgttttaaattgtaaaaaacaatactcttttctatctattagggggcgaaaaatgaatactgtcacaaaagaagccagcaaccttggtcaaaaacggctgttacatctgattgaaacgaagcaggcgattgtaggcgtgttaggcatgggatatgtgggattccctcttgcgctggaatgtgtcgataaaggatacaatgttatcggattcgacaaaaacagtgaaaaggtttccttgttagccgccggaagcagccatattcaagatatagaggacgacagactgaactcggctttacaaacaaaacgctttcaaatcagcgccgacatgtcgctcatccaaaaatgcgacatcattgtgatatgtgtgccgacacccctgaacaaaaaagacaagatccccgatttaacctacatcgacagtgcagttgacagcatgattgcttatggaaggcagcatcagcttttaattttagaaagcaccacctatcccggaacaacgaaaaaaaagattgccgacagaatggcagcaagccgcggcatgaaaataggaacagacttttttacggcttattctccggaaagaatcgatccgggcaacaggcaatatgaagtttcagatattcctaaagtagtcggcggaaccacacagacttgcacagaacttgcctcagcgttttacagcaccattgttacaagcattcacccggtcacctcacccgaagtagctgaaacagctaaactcctagagaatacttatcgttatgtcaatatagctcttatcaatgaaatggcgcttaattgccgtgaacttgatattgatatatgggaagtcatctgcgcggcggacacgaagccgttcggctttcaaaaatttatcccgggccccggagtcggaggccattgtatcccgattgatcctttttacttcaaatggatcgcgaatgaaaaagggctgcagacaaaattaattgatctcgcggacgaaatcaattccaacatgccgatttctgtctctgactatgctttgaaactggcgggcaaagacaaatgcagcatcttaataataggggccgcttataaaaaaaatacaaatgacccgcgtgaatcctcagtgtttacgataatggaagaattgatggacaagggatgcgcgattgattatcatgatccgtttatcagcgagatccgcttgaatgacggaagctgcaaacaatctgtccctttcacaaaagaacaaatcaatcagtacgacgtcatcatcattcatacagatcacgatgtcatcgactacagtattttgaaggatgtctcaccgattatctttgacacaagaaatgtatgcaaggaaaaatcagccgacaattgcagagttgtcactttataggagggaacggtcattagtaatcgatttatctcttttcacagacctgatatgacaagcgaagaaatcgcaagcgtaaccgaaacgattcaatcgggctggatttcgaaaggcccgaaggtaatcgattttgaaaaaaagctgggagaatgtataggagccgaacacgtcatcagctgtaattcaggcaccgctgcattacatatggctttattggcgctcggtgtgggagaaggcgatgaagtcatcgtgccgagcttcacgttctgttccagcgtcaatgtcatcctgcacgccggagccgttccggtgtttgcggatatatgcgagaaaagtctttgtgccgatcctgaagatgtccggaagaaaataacgccgcgcacaaaagcggtaattgcggttcattttgccggctatccggctgatctggaaaacttgcaatccatttgtaaagaaaacggattgtatctgattgaagacgccgctcatgcgctcggtacaaaatataacggaagcatgatcggcactcacggcgatgccgtgtgcttcagcttttatgccaccaaaaatattacaacgggggaaggcggagccctcgtcatgaaagacgaacaggccgcagaaagagcgaggctgtacggctggcacggcatcacaaaaaatgcctggaaccggtacggtgaaaaaggcagctggagatacgacgttttactgccgggctttaaatataatatgacggatattcaggccgcgctcggtctggttcaattgaagcgcgcaaacgacattcaagaaaaacgggaacagatcgctcaattttatgtacgtgaactgtcaggccaatctgacaaagcggcgcttccgctttctgacattccaaacggcataacgcactcatggcatttatttattttgcggattcgagaaaacggcggtatggacagagatctgtttattgagaaaatgaaagaaaaacaaatcgggctgagcgtgcactttattcccgtgcatttgcatccttactataaaaaacattttcctgcggagcttccggtaactgaacgtgttttccgggagatcgtgtcactgcctctttacagccagttatcagatgaggattgcagctatattgtcaagtctataaaagaagttttgactatcagccaggaggtaggatcatgaaacatattgcgattatcggaggagccggttttatcggaagcgaactggcggcattattacaggctaaaggttatcacaccatcattgcagaccagaagaagccggcttttgacactgaataccgccaaacggatatccttgaccggacgtccctccgcgaatcactgcggggagcggatgcggttgtccatttggcggcaatggtcggagtggacagctgccgaagcaatgaagaagacgtcatacgggtcaattttgaaggaacaaaaaatgtcactgaggtatgcggtgaattgggaatcagcacacttcttttctcatcgagttcagaagtgttcggagattcaccggattttccttataccgagacaagcagaaagcttccgaaatcagcttacggaaaagccaaactgcaatcagaggaatatttgagagaacaggcttccgacgaacttcatattcgggtcgtccggtactttaatgtatacgggccgaaacagcgcgaggattttgtcatcaacaagtttttcagcctggccgagaatggctctgagctgcctctttacggggacggcggacaaatacgctgcttcagctacatcagtgatatcgtcaccggaacttatctcgctctcattcatgaaggagccgtctttgaggacttcaatatcgggaacgaccagccgatcacgataaaagaactggctgaaaaagtcaatgtgctctcaggcagagagaaggataactatctgtttaaaaagctgggcgaagacggcgtgaggggaaaagacatcgaaatttttaagcgggcgccgtcaatcgagaaggcgaaacgtttgctcggttacgctccgaaagtaagtctgaatgaaggcctggagatcataaaagatgaaagacaaaagcacaaactttcactttcctaaaaacccggaagtggtcaaatatcccgtttatcccggacagttttccgtcagcggccgtctgcgcgcagtgaaacacttgcttactgccggacaaagcggactgactgaaaaactggaaaaacgttacggaaaaggggttgtgctgacctccagcggcagtgcggcactggtgctcgcattaacttattcgggggccgggccggggaaagaagtgattttctcatccttcagctgcccgaatgtcattgatgccgtgctgcaatccggtgcgacgcctgtgtttgcgcagctggatgagcatctattcttatcttttgaggatgtcaaaaaaaaagtgacgaggcgtacgtgtgcggttatcctcacgcatgtatacggccggagagaaaataccgctatcattgactgggcgaaggaacacggaattgctgtcattgatgatgccgctcaagccatgtttacaaaacaagcggatacatttgccggcggtttgggcgatttcggcattttaagcttcggcccctcaaagccgcttgcgagtatcggaggcggcgcgttaatcgcgccgaaagaatggcttcggcaaaaagcaaatctcccgatggaacagcgcagccaagtggcagctgactatcgaatctatatcagaaatcaaagaatccaagctgtaatgaaacggaaacggcatcatcctatttcatatatgtttagaaaagcgggcgccatgccttccatgaaagccacaaagctcgaagctctgccggataaaccggctgttgtacccgtgcttcgcatgcatccggcaagggaagccattattgatgatcagctttcacgtatggatcagcttgtaacagcttcgcttcgaaacttagagacggcgggagaaatctttgcaaaggcgggagaaacaaacggcataagaatgatccagccccaagaaggagaacatctgaattatttaacaattgtatttccccgggatgaagagcggtacgggtgttccgtttatttagccgaaagaggcatccaaacatgctggaactaccttcccctcgaacgtattccgatttatgaaacatacgcgggggaaggcggggaagacccgctttggaagagagttctttctctgccttttaaacctcctcttcaaaaggagcaagtcagatatatagccgaatccgttttatcatattatgagcaaaagaataagactgaatagtggtgataactatgcaaaaaacagcagtatgcacgacccgccaggcatgggatcgggccgctgacatgtatcaggcggggttgtttcaaagctatgattggggaatcctcatggaagagcttcccggcacgtcatttcaccctgtcagactgacaacggacggaggacaggtcatctatcttccgctttttgaacagaagggcgtattatccggcaacatgatcggatacggcggcgttatttcagatcgccccatctcatttgaatggcttcaaagtgaaatccaggccatattcggtcggaacatatcccggatgctgctgccgtacggtcagacttcttttacagaagaaatcagggaaggatggacggaaaaggcaacgcggattctttcgcttccggacacgtttgacgagctttggacgggcatttccggaaaagcccggacggcagtcagatacgctgaaaaagagaatattgtcacccggctgatcgggcgaaaagaacttggcgcgttttatgacctctacaaagagcatacagcgtcaatcggcgcagcttatgtgctgagccagggctttttccaaaagctgcttgacacgtttgcggaccggatgttttggatcggagcatatcaggatgagacgctgatcagcagcagtatttttctctatgaccgctctcatttctattattggcagaatgtaaacagcctggcgggaaaaaaagcgcaggcctcttacttattgatgcgtgacgccctgcaattcgccatttgccgcaagcttcaatgggctgattttggctattcacacagtaaagaaatcgcgagaccgaaacgatattggggagctgaagaaaaacaatgccgactttttacgaaaccggaatgaaaacaataagcggccatcaatccagttatctgccgtggtacggtttttttgaaaaaatgtataagtcggatctgtttgccattcatgacacagcccaatttgagaaaaaaggattcctcaaccgcaacagaatcaaaacgccgcaaggccccagatggctgacagtgcctttgcagatgaaacaatataaagacatagagcttcggcatatgaaaatcgaccagacacaggattggcggaaaaaacattggatggcgattaaaatgaactatgcgaaagctccctattttgagcgataccagcatttttttcaagatgtctatcagcgggagtgggaatatctccatgatttgaatatgcacatcattgaatttttccgaaaagagctccgaattgaaacgccgctctgttatgtctctgagcttgaatgccggaaggagaaaaaaagcgattttgttttagcgctttgtcaggagctgggggcggaccgttattattcaggcagtcagggttccgactatttaatagaaagcgattttgaaagaaacggaattgtcattgagtatcagcagatccgacattttggctatcctcaattattcggggagcatatccctcacctctccatgctcgatatgctgatgaactgcggagcggatacagctgaaatgttagttaaaggagggcaatatgatgaaagtaatggtatttgcagcgcatcccgacgatgaaattatcggcgtcggcggcacgctcgccaaacatgtccgccaaggtgacagcgtgtcggcagtcattatggcggaaggcaagtcatcaagaaaaacggattacaaaaagcctgaagattccgttatggagcattctaatcaagaaacggagcaggcgctcagcactttgggcatccatgattttgtcaggctgaaccttcctgataacagaatggattcaatggatttgctggatgtcgtgaaggaagcggagaaacaaatcaatcgttttcagcctgacattgtgtatacccagtacggcggtgacattaatattgaccactccgtcgtattcagagcggtcatgacggcaacccgtccgcttcccggtcatacggtaaaacgggtttttgcctatgaaacattgtcttcgacggaatggaattactgtcagaaggatcagtttcatgccaatttcttcgttaatattgaaaacgagcttgaaacgaaattgaaatcgatggcgtgttacggttccgagctcagagacttccctcatccccgctctttgcaggcgatcgaacataatgcccgtgtgtggggagcaaaagcgggtttttcggctgcggaagcgtttatgcttgtgagaggaacatggtgactgtcctatgattgctcaaattccgtttttcggacttgatccgaagcaaatcgatgagaaatgggtggaagcgggatacggtctggaagcgaatatttttgacggccattcctttggggaaacggattatctcaaaacattcaatcagacgctggaatatgcgaaacagcttgatccttcattattgacgctgcatttcccgacagatcatgccgattatgtgcatgaagatcacatcaaaaaacagctttatcactttgcggagctagctgtgaaatacggcgccaaaggcataaccgttcatgcgaatcaatttatgacggttgaggaatttcaagtctatgacctggaaggaaaccgtaaaaaaatcgttgagtttttcgcggagtttgatgagcggctgaaagggacagacatttggatcggtgtggaaaaccttccgatcatcgggaatctgggagaggattttgatccgattttcatttatcctgaggattttacagagctggtggagctggatctgaagcatgtcggtattacgtgggatctgtgccattgggcgattacctatcagactcacttgtcttccgcccttatgttcagaaatgatcagctgaaatatcccgatttctttcagtttctttcgataaaagagagcattaagcattatcacttcagctcatttcgccagcttgcgttcccgcatggcggcgtccgctgttttgagggccgccatccgagtgaagggacaatcgctgaggagctgctgagacgtgctgcagatactttgcaggagctttatcggactcaagataccggcattgtatttgaggtgatggaagaggattatacggaaagacgggaatcatggagaacgctggaatggttcggcggtgtttctgatgacgaggatcaaaaaagggtctgatatgacatatcgaacaccgaactatgcaaagctttggtgtgcacaggtgttttcttcagcagcggatggggtctggctcattgctttgccgctgttagtgttagaattgaccggcagcaaaattctagtcggcgttatttcttttatcgaactcgtgccgttgacatttggcgtgctggcggggccgctgattgatttattccgaaaaaagtcgatcttgtatttgtgcaatacgggccgggccgccattatgatcctcttggcggtgctcagcgcgaacgatttattaaccgtgtggatagccggggtgtgcgccttttgtctatctctgcaatcgatgctgtttgcgccggcgaaagtcgcgatcattccgctgctcgtccgcaaacagcatcttgatcaggcgacatctctgatcaatacgagtgacttgatcggactcatcgtcggaaaattgatcagcgggatcatgattgcggctattccgttcgggatgctgtttgccctaaacggcactgcttttttgatctctgcggcatttatcgcgttcattcgtatttcagaacagcccaatgaaaaaagcaacggaactgaagatgtaaaagccggttacagaatgctgaaaggaaatgcggcatggctgacatcggtcggatactttttcgtcgtaaatctcgtcattgccggccttatttcagtaatggggccgattcttgctgtggagcgttttcagcagaactattctgtatggtttgccgtcatgtattcaatgtttcaggcggggatgcttttgggcaatctggccgtatttttcaaatggaatacaaaacgcttgaaccggctgtacccgcggacgttaacggtagcgggactgctcattatgctgctgttttttccccttcatgggtttgagtgcatcatcttcctggtgcttggcatcatcatctcgtatattgatgtgcaaacggtgctgtatttccaaaagacggttccggccgcatatttcggaagggtctttgcactgattttttccattgtcaaaatgggtgaaccgctgtcggccgctgtctacacagggcttctgctgttgatgaatgcggattatattttcgcggcggtcggactgacccttacgatcgtttttgctattttttcagtcagacaagggagtcaaagaaatacagagaaacaagcggatcaatccgtctgaatggtaaacgaaggggcgccgatgtcagccggcgccctttttatcataaatccaaataaagccgtatcatatcccggcattgaatgccgttttcaaaaatgtcttcatcataatgtctgataaaaaaatcatggtcgacagcctgaatgcggaatccgcatttttgatagagtgacagctgatgaatactggaatttccggtgccgatttcaatcgtgtcagctcccgattgtctcgctttttcaatggcatcccgcaccagctgttttccgaatcccctgttctgcagcgattcttttaccgcgatgtttacgatttctatcgttttaggccttgtttgcaataaaacgtaaacccctgcaagctcgtctgacgtccaagccgtatagcattctcctcttacaagataatcatcgacaatctctttcgacggatcggccagcagcaatagttcatacagcgcttcatccggctccgcggcttttcggatgctcagtttttgcatgtccgtttctcctcctccgttatgatcgacagctatttttgaaaataactccaaaatcattctactttattataaaatatgaaacataggaaaagttatacaagttttgcagattgaataggaggaaagtcatgtttttttgtaagcattgcggccagcagaacaatgaagaagcgcatttctgtaaagaatgcggaaaaccgatcgggaaaggaagccggctggagcggcaggcggctgtaaaagcggctgaacctgcttcacaaatgagaaagccgatccctaaaaaaacgctcttcatgtggggcggcattgccgcagcgctgatcttattgattgccgcatataaaaccggagcctggctgacatctgaaaaaaggctcacggatcaattcgaacaggcggttcatgacggggacacgaaaaagctcgcagccctgctcactccttcagacaaaaaactgaagctgaatgagaccaatgtcaaaccgctccttgcatacgcaaagaaacacgatgaactgctggcagcgcttcgcggcaattcatcagaaacagatgcggtatacgttaaaaaagagggaaaaacccttcttttgtttgaccattacgaactgaaagtcgatccggtttatttccgcgtcacaagcaattataaaggcgccgatctttatatcaacagcgagaaaacaggtacggtcaaaaaagccgatgaaatccaaatcttcggcccgtatgcacccggtgtctacacggcggaagccaagcttaaaaatgagacggttgacgttgtcaaaaagcaagaggcagaggcggccggaagccggaatgttgagtttgacctgccgttagacgccgaggatgtgacattcactcaagcagacagcttcaaaagcgcgaaaggcgatctgctgataaacggcaagtccgtccataaagatccgtttacatccgttacatatggtccgctcttaactgacggttccatgacagccgccgtggaggctgattttccttgggggaaaatgaaaactgccgatgtcccgatcaacagtactgatgtggacttaacgcttatcccggatcaagatacacaacaaacaatcatggacacgattgtcaaaacaacgaagcagtatacaaaagcgatggcagacggaaataccgatcagatgaccgaggctggttccgcctggaaagagcagacgaaagaagtggtatccggcatgaagagttccggcacctttttgaaggatcagtataaagagacaagctttgatctggattcatttgcgatttctcaagagaacggccgctggcaagtaactgttacgggtaaagagcttcatgagtctgcttatttcgacgggaatacgaagcctgatatggaagaggctgagccgagctttcactatgtactctcatatgatacaaaacataaaaaatgggttttcgaaaaagctgaccctgcctcagattcttctgggacaaatgtaaaaaaaataaaaaacgaccagccgaaaacctatacatccgcatgggcatcttccaaaggaaacacagcttcaggcagcgtgacaaacgagcaagtcacatcgtttatgactgattacctgacaaatcaatcaagcgccgtcagccttaacaattttgccatcatggcgggtaatttagaagagggaagccctttgtatgctgatcagcagaaactggtcaaaaaactgcacagcgaggggacgaccgaagtatttaatgaagtgaatgtcaaaagcttttcacagaaaggctctcatctgacgattcacacgtacgaggagttttatattacgaaagccggcggcagtccgaagctcagaacatacaattggacgtatggcggcgttgttaaagacggaagaatttatttaacatccattcaataaaaaaacccccgcgccaatcaggcggcgggggtttccgtttttaaaagaagaaataattcatgagttcttttatataatgcttgatcgtgaattgaaacgttacgcaaatgatcaaatagatgacgataacagaataaatgatatccgccttagtagtgagctgatgctgatagctcgccagcatgagcggaggcacggcaaacgccgctcctaaaagaccgacagccagaatggtgaagcaaacggttgtatgaagcagcataaaaatgagggcaagaagcaaaatagctgtaaacggaatcaaaaatgccccgaatctggacagcgaatctttaaatgacacctgggcgccgccggccttcaaagcgataaaaatcaagagatacaggcaaaaaacgcataatgcaaaggtaagcgccggcttgatcacaaccgcggtaaaactgacgtcacgaaagccgtctgataagagaatataaaacataaccggcgtcaccaggcagaaaagcaccatgttgatgatgctgctgacaagctgttcgccgcctgtcgttttacatgtttgatacggtcgctttaacacatcaagcacgaataaggcaaattgctttgaagcctgcttagccgcggcgccggcctgagcggcctggccttgcgtttgacctgcgcctccctgcccgggctggggcgccccgcacttttcacaaaattttccgccatcagtatgatggccgcattgagaacaatacattctaaaactccttttacaagtaatatagggattttgttcaatatttacattataaaagaaaataggacggatgtaacggagttttctaaagatatacaaatcaccttctctatgaattgataatagagaaaaagtaccctttatggtagaattttattggagctgatagatatcatgtctctcggcgcattgattcagagtgaaaaaggaaattaacgcatgctaaaaaaattgaaaatgctttatcggctgttaaaattcggaaaaggcttatggagatagcaaacagaaaaaaccgtccttacaaggacggtttttttctgtttccggatcgtccggctgaggttataaaaagcagaccccggggtaaaaaccatgcataagaaacagcggagaacaaaacataactcaataacggcaagtcataaggaggtacgcatgttttcattcatcattcatgtcttcatttcactgtttgcagtctccaatcccatcggaaacgtgccgattttcctttcactgacggaagggtactcggagaaagaacggacagcgatcgcgcgcaaggcttccgtgctgtcgtttatcatcttggcggcttttttaatcttcggccatctgatctttaaactgtttgacattaacattcatgccttacgtatcgcgggcggcatttttattttcggcatcgcttataatcttctgaacgcgaagaaatctcatgtacagtctctccatcatgaagagaaaggggagagcaaggagaaagccgatatatctgtgacgcctttgtcgattccgattatcgccggacccggtacgatcgcgacggtgatgagtctgtcggccggccatggcggcatcttccattacatcagcgtgcttatcggcattgcggccgtcatcgcgatgacgttcatcttctttcactattcatctttcatcagcaataagctcgggaaaaccgaaatgaacgtcattacccgactgatggggctgattttggcggtggtggccatcggcatgatcggcgccggtctgaaaggcatgttcccgatattggtttcctgacttaaaaaagcagcgcccggttatcttcgggtgctgcttttttctattttcggcacatgctgaaacacttcttcactctcaaaaaattctatcaaacggctcagccagtcataataatggagccaatccgtcagttcatccaaaagctgacgggctttttcttcaatatcgggactgagattttccgattccagaagctcagtcagctcgcggttcagctttttatagagcattttgtttttgctgaccgcctttgtccaatttgccgtaaacagggagataaacgtctggtaataatcacgctccacgtcataaaggtctttccgaacgcctttttcaaacactttttcagccagattgacatcggtcatttcgcggaccacctggctcatcctcgttttgctcatcccggtcgcctctgacagctcatttaacgtcatcggcttgcggttcatataaataataccgagcacacgtcccagtgtggccggcattccgaatgtatgcatattctcggcgattctctcaatgagatgctcttcagcatgcccgatgatatcaagagcgtttttttccacggctgatcatcccttcactggcttttcatgctgacaatatatcatattttttacagttgatgaaaaagatgatgcggcaggatatgcgagctatcgggagcgattgtaagaacatccgcattgtcagcgggataacatgaaaaaatacgtatattgtatataatttcaacacattgtaaactttttattttacaaatttcatcttataataaagattatacttttcagaaaaataacggaacccttcggaggtgcacggattgctgagattagaaaatgtatcaaaagtctataaaggcggaaaaaaagctgtcaacagcattgatttaaatatcgaaaaaggcgaatttatttgttttatcgggccgagcggctgcggaaaaacgacgacgatgaaaatgattaacagactgattgagccgtcatccggaaagatttttatcgatggcgaaaacattatggagcaggacccggtggagctgagacggaaaatcggctacgtcattcagcagatcggacttttccctcatatgaccattcagcagaacatttccctcgtgccgaaactgctgaaatggccggaacaaaagcggaaggaacgggcgcgggagcttttgaagctcgtcgatatgggcccggaatatttagaccgctatcctcacgagctgagcgggggacagcagcagagaatcggcgtgctgcgcgcccttgcagcggaaccgcctcttattcttatggatgaaccgttcggagcacttgatccgattacgcgggattcccttcaagaagaattcaaaaaactgcaaagaacattgaataaaacgattgtctttgtaacccacgatatggatgaagccattaagctggctgaccggatcgtcattttaaaagcgggagagatcgttcaggccggcactcctgatgacatcctccggaatccggctaatgagtttgtcgaagaatttatcggcaaagaacggttattgcaatcaagaccggatattgaacgcgtcgagcagatgatgaacaaaaagcctgtcaccgttacggcggacaaaacgctttcgcaggcgatacaggtgatgcgggaacaccgtgtcgattccctgcttgtcgttgatgacctgaatgtgctgcaaggatatgtggatgtggaaatcattgatcagaaccggaaaaaagcgagcctcgtcggcgacgtgctccgctctgatctgtatacggtcgagcaggggacactgctgcgtgataccgtacgcaaaattttaaagcgcggaatgaaatatgtacccgtcgttgatgaacaaaggcatttagtcggaattgtcacgagagcgagccttgtcgacatcgtttacgattcaatctggggtgaggaagaccagctggtgacaggctgacaaggggaggaacgcttacaatgaatgaaatgatcaagtttttgcagacgaacggcggagaactgttatataaaacgtgggagcatttatacatttcgatcatcgccgtcatattaggcattgtcgtcgccgttccgctcggagtggcgcttacgagaatgaaaaagggcgcaggcgccgtcatcggcgccgtcaacattgtgcagaccttgccgagtctcgcgatactggcgttttttatcccgctgttaggcgtgggaaaggtgcccgcgatcgtcgcgctgtttttctattcggtgctgccgattctccggaacacgtataccggcattcaaggcgtaaacaaaaatctgctggaatcgggaaaaggcatcggcatgacggtctgggagcagatcaggcttgtggaactgccgcttgcggttccggtgatcatggcgggcatccgcacatccaccatttatctgatcggctgggcgacgcttgcttcctttatcgggggcggcgggctcggagactatatttttatcggcctgaatctctatcagcctgaatatattatcggcggcgccgtgccggtcaccattttagccattatcattgattatctgctagcggcgacggaacggaaggtgacgccgaaagggctgaaaggactgaaggaagtatcataaggagttggctgttttgaaaagaaaccaaaagagatggatgtgcgcactggcgctgtcagctgctctgcttctaggcggctgttcccttcccggcctgagcggggcttccgatgatacgatcaaaatcggggcgcaaagcatgacggaatcagaaattatcgccaatatgatcgcacagatgattgagcacaatacagacttgaatacggcattaattaaaaacctcggatcgaactatgtccagcagcaagcgatgctcggcggtgaaatcgatatcgccgcgacgcgctactcgggaacggatttaacgagcaccctcggcatggaagcggaaaaagacccgaaaaaagcattatccatcgtacagaaagaatttgagaaacgcttccattacaaatggtttgattcttacggatttgagaacacatacgcttttaccgtcacgaaagagcttgcggaaaaagaccatttagacaaagtgtccgatattaagaagcatgcggatcaatttaagctcggtgtagacaatgcgtggctgaaaagaaaaggtgacggctataaaggctttaccgacacgtacggctttgaattcggcacaacctatccgatgcagatcggacttgtatacgatgccgtgaaaaacgggaaaatggacgccgtcctcgcttattcaacggacggacggatcaaagcgtacgatctaaaaattttaaaagacgacaagcagtttttcccgccgtatgactgttcgccggtcattcccgacagcgtgctgaagcagcatcctgaactgaagggcattgtgaataaactgatcggcaaaatcgatacggaaacgatgcaggaattgaattacgaggtggacggcaagctgaaagaaccgtccgtcgtcgctaaagaatttttggagaaacatcattattttgaataagaaatgaggtggggcaaatggaagtgctgcagcagctcggcacttattattctcaaaacggcgcctatgtgcttcaggagttttaccgccattttctcatgtcggtatacggcgttttatttgcggcgatcgtcggggttccgctcggcatcttcattgccaggcacagaacattaagcggctgggtattcgcggtgacaaacgtgattcagaccgtgccggcgcttgcgatgcttgcggtgctgatgctcgtcatggggctcggcgccaatacggtgatattgtcgctgtttttatattcgcttcttccgatcatccggaatacgtacacgggcatcgccagcattgaacacgcttatcttgaatcgggaaaagcgatgggcatgaccaaatttcaggtgctccgcatggtggagctgccgcttgcgctttccgtcatcatggcggggctgcggacggcgctcgtcatcgcgatcggcattacggcaatcggtacgtttgtcggcgcgggcggactcggtgacattattgtcaggggctcaaacgccacgaacggaaccgcgattattttggccggcgccattccgacagcgctgatggccgttatcgcagatcttgtgatggcatggctggagcgggcgctgagtccggtgagaaagaaaaaacgaaccaaagcgccgaatgcggcatgaaaaaaaacgccttgcgggtcagggcgtttttttcttatggcttcggaacatgcttgaaaatttcttcgctttcaaaaaactcgatcagacggctgatccaattgtagtaatctagccaatcctttaattctttcagcagttcgttgattttttcctcagcttcttccggcacgccgttttcaaggacggctgtcagttcgcggttcagctttttatgcatcattttatttttgctgacgaccttgctccatgtggccgtaaacagcgtaataaaggtttggtaataatcctgctcgacgtcgtataaatctttgcggacgcctttttcaaacactttttccgccagattgacgtcaagcatttcacggaccgcctgactcattctcgtcttgctcatgccggtcgcttctgataattcagttaaggtcatcggcttgcggttcatataaataatgcctaaaatgcgccccaccgtcgcgggcattccgaatgtatgcatattttcagcgattcgttctatcaaatgatcttcagcttgttcgattacgtgtaacggatctttctccaacagtttcaatcctttcagtcagcaattccgatgtcaatataccacatttttaaaccggcggaaatgctcttccgagagaatttggcagtaatccggagcaataagaagaactttgccggtcaatacgggttaatcagtgcttacacaacctttatatataatatggacaaattgtaaactttttaatttacaaagtttaatttataatggaaaacgttcaattgtctgaaaagttaaatttgaatttaacgaattgaataaacttaatcgtggaggtgtgagtgtttgctgacattagaaaatgtctcgaaaatgtataaaggcgggaaaaaagccgtcaacagcatcaacctgaatatcgccaaaggcgaatttatttgttttatcgggccgagcggctgcggcaaaacgacgacgatgaaaatgatcaaccgcttaattgaaccgacagaaggcagaatcctgatagagggccgaaacattatggaacaagacccggtggaactcagaagaagcatcggctatgtcatccagcagatcgggctgtttccgcatatgaccattcagcagaacattacgctcgttccgaagcttttaaagcatcctgccgaaaaacggaaggaacgggcgcgggagcttttaaagctcgttgatatggggcctgaatatttagaccgttaccctcatgaactgagcggaggacagcagcagcgaataggtgtattacgggcacttgccgcagagccgccgctcatcttaatggatgaaccgttcggggcacttgacccgattacgagagattcccttcaggaagaatttaaaaaactgcaaaaaaccttacataaaaccatcgtatttgttacccatgatatggacgaagccatcaagcttgcggacagaatcgtcattctgaaagcgggagaaatcgtccaggccggaacgcctgatgagattctcagatttccggcgaatgaatttgttgaggagtttatcggcaaggaacggctgatccaatcatccagccctgatattgaacgggtggagcagatcatgaatcccgatcccgtgacggtaacacctgagaaaacactgtcagccgccattcagctgatgcgtgccgagcgggtggattcgctgctcgtcattgatgaaaagaacgttctccaaggttatgtcgatgtggagatgattgaccgcaatcgaagacaagcggtaaccgtcgcggaagtgcttgaccgggatctgtacacggtcagaagcggcactctgctccgcgacgccgtccataaaattttaaaaagaggcatgaaatttgtgccggtccttgatgaagccggccggctaacgggaatcgtgacaagggcaagcctcgttgacatcgtctatgactccatctggggagaagagaatcagctcgcggtgatgttatgaggaggcttcaattgatatgaatcagaccgtgcaatttttacaggcaaatggaggagagatgctttataaaacatgggagcatctgtacatctcattaatcgccgtcatggcgggcattctcgccgccgttccgctcggcgtcgtgctgacgaggatgaaaagaggagccggcgccgtcatcggcatcgtcaacatcattcaaaccttgccgagccttgccattcttgcgttttttattccgcttttaggcgtaggaaagatcccggccgttgcggcgctgtttttctattccatgctgccgattctcagaaacacgtatacggggattctcggcgtcaatcggcatcttctggaatcgggaaaaggaatcggcatgacggcatgggagcagatcaggcttgtagaactcccgcttgccgctccggtcatcatggcgggcatcaggacgtcttcgatttatttaatcggctgggcgacgctcgcctcctttatcggcggaggcgggctgggagattacatttttatcggcttgaacctttatcagccggagtatattatcgcaggcgccgttccggtcacagtgctggcggcagccgtcgattacatgctggggatgacagaacggaaagtcacgcctgacgggctgaaaagcataaaggacgcttcataaggaggaggtctctcatggggaatagatgcaaaaaacggctgctcgcaatcgcctgtatcggcatgctgctccttggcggatgctcgctcccgggattgagcgccgcatcggaggacaccattaaaatcggcgcgcaaagcatgaccgaatcagaaatcatcgcgagcatgctcggacagatgatcgaacatcacagcgggttgaagacaacggttattaaaaatctcggctccaatgccgtacagcagcaatccttgataaacggtgatattgatatcgccgcgacgcgctatacaggagacgcgctgacgggcacgcttcgcatggagccggaaaaagacccggacaaagcgctgcggctcgttcagcgtgaatttcaaaacagatatgacatgaaatggtttgattcttacggctttgataatacatacgtctttaccgtttccggacagcttgcccgcaagtatcatttagaatcggtatccgatgtcaaaaaagaagcgtctcatctgaaattcggcgtcgataactactggatgaagctgagaggcaacggatatcaggattttatgaacacatacggaatgtcatttgaaggtacgtatccgatgcagatcggccttgtttacgacgcgctgaaaagcagaaagatggatatcgcgctcgcttattccaccgacggaagaatcatcgcttacggactgaaaacgctgaaggatgataagcggttctttcctccgtatgactgttcacccgtcgttccggatcaagtattaaaagagcatcccgaactggagggcgtgatcaataaaatgatcggcgcgattgatacaaagatgatgcagaaaatgaattacgaagttgacggccgattaaaagagccgtccgtcgtggccaaggaatatttagaaaaacatcattactttgaataacggaaaggagatgtgcggatggacacgatgaaggagctgtttacgtattatgctcaaaacggcagttatgttctgtatgagtgctggcggcactttctcatgtcggcgtacggcgtcgttttcgccgccattttcgccattccggccggaattgtgacagcaaggcacgggcgtctcgccggctgggtgtttgctgtggcgaacgtgattcaaaccgttccggcgcttgcgatgctcgccgtcctgatgctcgtcatgggactcggcgccaatacggtcatcacggctttgtttttgtattcactgctgccgattctcagaaatacgcacacgggcattatcaatatcgagcacgcttatctcgagtcgggaaaagcgatgggcatgacgaaataccaaatccttcgtatggtggagctgccgcttgcgctttccgtcattatggcgggtctccgaacggcgctcgtcattgcgatcggcatcacggcgatcggcaccttcgtcggggcgggcggcctcggcgatatgatcgtcagagggtcgaacgcgacaaacggaaccgccattattttggcgggcgccatcccgaccgcgctgatggcggtagccgcagacctgctgatggcgtggctggaacgagccctcagcccggtgaaaaaacaaaaaagaaagctgatcgtacgctcagcctcatgaaaaaagcattcttccgcgtgaagaatgcttttttttgatttcttgattaaattttgataactgcgctgtaaagtcttacttatcaaataacaaagcagaggggtaatcaaatgagcaacatcatagaaacgagacagctgcaaaaatcattcggcagacaacaggcagtggctgatgtgtctctatcagtaaaacgcaacagtatatacggcctgctcggtccgaacggcgcgggaaaatcaacgacacttaaaatattgaccggcatgctgcagcaaacatccggcgaggttctgttcgacggacatacatggaagcgcgaagatttgaaaagcatcggttccctgattgaagcgccgccgctttacagcaacctgacagccgctgaaaatctgaaagtccgctgcgtgatgctcggactgcctgattcaagaattgcggaagtgctggaaatcacgggattaacgggaaccggaaaaaagcgcgccggacaattttctatgggaatgaagcagcgtctcggcattgcgttagcattattaaaccgtccgtcgctcttaattcttgatgagccgacaaacggattggacccgatgggaattcaggatttgcgggaatttatccgctctctgcccggacagggaatgacggttattttatctagccacctgttatcagaagtcgagcagatcgcagaccatatcggaatcatcagtgacggcgttttaggatatcagggagaaatcagccgggaagacgatctggagcggctgtttctggaggttgtcaaatcaacacgggagaaagcggggactgggaaatgattcagtacatgcaggcggaacatcttacatctaaaagaacatttatcagaaagctgatcattcttatcccgcttctgaacacggctttttcttttctgctgaatgccgcctattttatgacgggcacgttcaattggtgggcggttattttcatgccgctcatgattgctctaatgtgcggtttatctgttaaaaaagagaaaaaatcagcgaatgaccgtgcggtgtactcactgccggctgacttgaagagcatatggttctcaaaaataagcttgatcgcgctgtattcactcctgtcgcaaatcgtctttttagtcatcatgttttttcttggccttgtgtttccggcaattgctgcggttcagctgaaaggtattgaagcaagctcccttctgtggctgtctacgctttgggaaattccgttctgcttatggattgccagacagttcgggtttacggcagtgatcctcatgaatatgatcgccgcctttgttttaggcattgtgccggcgtcaggctcattgtggtggctgagtccatggagctggtcagtccggctgatgtcaccgattctcgggatccatccgaacggaattccgcttcctgcaaacagcggcttattaaacggaaacgtgatcattccggctattattctttctattctttcttttatcgcggtaagttttgtttccgccgtgtctttttcaaaagggggaaaccggtcatgaccgtgcttttacgatatatgtgggccgatgtattaaaaatgaagcgtacgccgctcatatggatgcatgctgcggcgccggttttatgcgcgggatttttcctgttgtatatgtatggaagggttcaggagccttatatgctgtacagtgtgtttttcagcgcgattgccgttttataccctttaatcatcagtattgtctgcggcatgtctgcctcggttgaggaacaggcgggccattttcagatgatgctggcggccccgcattctaaaatcatcagttttgcgggtaagctgcttttgctgctcctattgaatgtgttatcggtaggtctcgccatctgtctttatttggcggggatgaaatttgttcttcacatcaatgatctcccgtatcttctctttttaaaaggaggggcgtggctgattgccggcagtattccgctttatatgatgtctttttttgtcggcataaagtacggcatgggaccgtccgggcttttagggggagcgggtttattaatggcggcgctcatgaatacgggacttggcgataccatctggcgttttttcccgtgggcatggagcgtgcggctttcaggccttgcaggactgctgcattttgacaaagtcaaaaaagagttcctcccttatgtaagatacgatatgagattcggagaaataatgttatatttttctatagtgatattatgtctggccggcctctattggtgcagaagatgggaagggcggcgttcatatgaataaaggcaaggagcgattcggccggtggcaaacattttagcaattgatgatgaaaaagatattctcgttctgatcagaaacattttacagcgtgatcagcatacagtaacgattctggaaaaagcggaggatcagtcattggatttttttcaaggctatgatttgattcttcttgatgtcatgatgcccggaacggacgggattgaactctgccggcggattcggccgctggtggacagcccgatcctgtttttaacggcaaagtctgacgaagaatccattgtgaaaggcctcatgacaggcgctgatgattacatcacaaagccgttcggcgtacaggaattgatggcaagggtaaacgcgcatgtcagaagggaacggcgggaaaagcatcagacgaaacggctgatatcaggcttcatgtttgattttgacaataaagaagtatggattgatgaccggaaactgcctcttacgaaaaacgaatataaaatcgttgaatgtctggcacagcataaaaacagaacattctcacgggagcagatttacgaggaagtgtacggcttggacggcgatgcgctctattcaaccattacggagtttatcagaaccatccggaaaaaatgtaaagaacacggggctgatccgatcaaaacggtgtggggtgtcggatacaaatgggaatagcaaaaggaaaatccagcatccgcaaagagcttgtcaaatttacgatcacactgtgtctgagcacgatgggggtggcggcattatgtgtcgccttaaatgccattgctatgaatgccggagcgatcctgcccgcaaactacagcgagcatgaggcggaacagatcaaaccccgcctgaaatcagcggaaaagataacagaagacatgatccccgcaggtatgacatacgccgtttttgataaaaaaacaaagcggatgacaaaaggaacgatgacggaacaagatgcggccaacgcgagaaaaaagattcagcatcagccgtattttaattatgctcaaaaaggattcatggtgataaatcggaaagatgaatacggcgttctccaatattcactcaggtcggaatttcagtcgccgctgttaaggcgctatctgccgaattatgaatggacgggtcttacgattctgatcactttgcttcttttgaccgtttttattgtgacgacgcgtttcgccaatcagctgagacggcatttcagcacactcagctccattacggcaagcattcaaaaacagaatttaaatatcaatccaaaaaggtcgcgtataaaagaatttgacgatgtcattgactctctgctgaaaatgaaagacgcgcttcaggcatctttggcagcgcagtgggaggcggagcggataaagaaagaacaaatcggcgcgcttgcgcatgatattaaaattccggcaacgattattaaaggaaatgccgagctgcttcagttaacaaagcctgatgaggagcaggcggaatatgcgcagtatattctggatgccggaaacaaaatcgagcattatgtcggacagctgatccagctttctaaagcggaggaggcagttgccgttcatgtggaatataccgacctcaaagagtggattcaaaacatatatcgtgacgcggcggcgcttgcggggccgaaacagattgatctcgtcctcagcgaacggggaattgacagaaaagaagcgccgatcgatcatgagctgctccacagggcggtcatgaatatcgcggcaaatgccgtcgactatacgccggaaggaggggaaatccgtgtggacgtcctgtgcaccgattccgccctccatctcgccgtatccgacagcggaagcgggttctcgccggaagcgctgaaaagagcgacacagcttttttacacggaggataaaagcagacattcggcggggcatcacggcatggggcttacattcgcccatcatgtcgtacatcttcaccacggcgaattaatacttgaaaatcaggagtctggaggagcccgggcggagattcgaattccgctggaaggcgtcagacaaaaacaagccctgcacgcctgagggcttgtttttctgtttaagaaaagcaaaaataaaaacggctgtccgtttgagagatcagccgcttatgcggaaaagagtttatcaggaaggatcaatccatgttgaagaccacttggaaatttcctctaaaataggggctaatgcgcagcctttttccgttaaagaatactcaatgcggacaggcgtttcggggataacatcccgtttgatgacaccttctgtttcaagttctttcagacgttctgacaagactcttccgcttaaattcggaagcgccgcttcaatttcgctaaatcgctgctgtccgttcaataactgaaagacgattagagccacccagcgtttacttaggatgtcgaccgctttttcgaatctggggcacatttctgattggttcatgctttttcacctcgtcttctgctattataccgcaaaatcggagggaacgtacgtctggcgcttgttaagttgaggagaggatcaaaaagaggatgaggaatccggggagcgctttttcgcttcagccgcgataaaatcaaagtatttgctgacgctttcaatatcttcttttgtgaagtgctgccactttttgctgtcaaacagcggcagatgctccgcgcctctgtcaacggcggtctgatagatggcgcagatggattgatagctttcggaggtttcgcggatttcttcctgaaatgccttgatgtgtccggcccgcgccattaactcctcgtacggaatttttaatgtgtccgccaattttcggatggtcgcgggtttaggaatgccgcggtgcccgttttcaattctggaaatggtcgccgagctgacgccggaatagacggcaagctgattgacggtaagcttccgggcgcggcgcagctctcttaattgctttccgaatgtgttcaataagatcgcctcacatgtgcaaagtcatgagtcttcatttgttctttttttggcttcagccgataagaacgcaaagtatttatcaagcagaaccaagtcttctttcgacaggtgccgccagttctcccgctccaatagggataaatcatgcagctcatacgtttcggctttttccagcaaggtgcagcccgtgtcgtacggggctctcgtttcctggacggtctctatgtatcccgccgtctgcatcagttcctcatacgggatttttaacgcatctgcgagctttttaatggttgcaggtttcggcaccccgcgtttgccgttttcaatccgcgagattcccgcggcgctcacgcctgaatacgttgccagctgattcactgtcagatgccttttttcccgcaatgtccgcaattgtttcccgaagctttccacagtctctccccctcccgcggtctatttatattctagtatgtttattgactaaagggaatagccaggctggaaaagtattgacaaaagttaacaaaagccgtatcttatgtataagaaagaaagtatttgacagaacggaaggtgaagaaagtggtcgaaaagatacagatcagaagagattatgtgctgcagtatatggtcaataatgactactcgttaaaccagctcgccctggagatcggaatatctcccgccacactgagccgtgtactgaatggagagcggaggccgggccagctggtcatcggaaaaatgctctattactttgacatgaaatttgaagatcttttttactacgactttgttgacaaaagtcaatgatgatggaagattcaaacgcatttccgtttttctgacatgatgtgcaccgatacggcgtgacatgcctttgtttttcatgtaaaatagaagcaatgtaggccagtcagtctggaggtgtatgggatgcacacattattgattaccttattggtcatcgtcagtattgcacttattattgtcgtattgcttcaaaccagcaaaagcgccggtttatcgggtgcaatttcaggcggggcggagcagcttttcggaaaacagaaagcaaggggccttgatctgattcttcaccgcacaaccgttgtgctggcagtcttgtttttcgtgttgacgatttcgctggcgtatatcgtataaggcaatgtttgtataaggtctgatttaatatcaggcctttttcttgttgagagacggcgtttgtttctcgcaaaactgtggaaaactaaattgaatgtgcaaaaaaggggttatgagcatgaaaattgtgacaccaaaaccatttacatttaaaggcggagacaaagcggtgcttctgctgcacggatttacgggaaatacggcagacgtcagaatgctcggccgctacttgaatgagcgcggctacacttgtcacgcgcctcaatataaagggcacggcgttccgccggaagaactggtacatacggagcctgaagattggtggaaagacgtcatggacggttatgaatatttacggtctgaaggctatgaaaacattgcggcctgcggactgtcgcttggcggggttttttcattgaaattgggttacactgtacccataaagggaattgttcctatgtgtgcgccgatgcacattaaaagtgaagaggttatgtacgaaggagttctctcctacgcgcgcaattataaaaaattcgaaggaaaacagccggagcagattgaaaaggaaatgaaggagtttgaaaaaacaccgatgaatacgctcaaatcgcttcaggagctgattgccgatgtgcgcaaaaacgtcgacatgatctattccccgacatttgtggttcaggcacggcatgaccatatgattaatacagaaagtgcgaacatcatttacaacgaggtggaaacggacgacaaacagctgaaatggtatgaagaatcaggtcatgtcattacgctcgataaagaacgggacctcgttcatcaggatgtgtacgaatttttagagaaactcgattggtaacaaacaggaggtcgaataatggaaaaagaagcgtttatggaccgtcttctcgcgtttatgaaggaagaggcgtacaagccccttaccgttcaggaactcgaggagatgctgaacatcacggaagcagatgaatttaaagagctggtaaaagcgctggtggcgctcgaggagacgggacagatcgtccgcaccagaagcaaccgctacgggcttccggaaaaaatgaatttagtaaaaggtaaaatttccgcgcatgcgaaaggattcgcgtttctattgccggaggatacctctttaagcgacgtgtttattccgccgaatgagctgaatacggccatgaacggcgatatcgtcatggtgcggctcaattcccagtcaagcggatcaagacaggaaggcacggtcatccgcatcttggaaagaagcatcgaccgtgtcgtgggcacatacacagaaacgaaaagcttcggctttgtcatcccggatgataagaaaatcacgagtgatatttttattccgaaacatgccaataacggcgctgcggaaggtcataaagtcgtcgtcaaactgacaagctaccctgaaggcagaatgaacgccgaaggagaaatcattgaaatactcggccataaaaatgatcccggcatcgatattttatcaatcatccataagcacggcctgccgggagattttccggctgaagtgatggagcaggcaacaagcacgcccgataccatcgatgaaaaagacatcaaagaccgccgtgatctccgcgatcaggtcattgtcaccattgacggcgcggatgcgaaggatctggatgacgccgtcactgtaacaaagcttgataacggcagctacaagctcggcgttcatattgccgacgtcagccattacgtcacggagaattccccgattgacaaagaagcgctggatagagggacaagcgtgtacttggttgaccgggtcattccgatgattccgcacagactgtctaacggaatctgttctttaaatccgaaggtcgaccggctgacgctttcctgcgaaatgacaatcaaccagcagggccaggtgacagagcacgagatcttccaaagcgtcattaaaacgacggaaagaatgacctattcagatgtcaaccggatcctcacagaagacgacgccgagctgaaagaaagatatgagccgctcgtcccgatgtttaaagacatggaacgtctggcggaaattctccgggcgaaacggatggaccgcggcgccgtggattttgatttcaaagaggcgaaagtgctcgtcgatgaggaaggcgccgttaaagacgtcgtcatcagagagcgctcagtagcggaaaagctgattgaagaattcatgcttgtggcaaacgaaacggtggccgagcacttccattggatgaacgtgccgtttatttaccggattcacgaagagccgaacgccgaaaaactgcaaaagttcttggagttcgtcacgacattcggttatatcgtcaaaggaaaagccggagacattcatccgcgcgcgctgcaaagcattcttgacgaagtgcgggaccgtccggaagaaacggtgatttcaaccgtcatgctccgttccatgaagcaggcgaaatacgacccgcaaagcctgggccatttcgggctggcgactgaattttatacgcacttcacatcgccgatccgccgttatcctgacttaatcgttcacaggctgatcagaacgtatttgatcaacggacaatcggacgaagcgactcaagaaaagtgggccgaacgccttccggaaatcgctgaccatacgtcaacgatggaacggcgcgccgttgatgcagagcgggaaacggacgatctgaaaaaagcggaatatatgcttgataaaatcggcgaggaatttgacggcatgatcagttccgtcacgaatttcggaatgtttgtcgagctgccgaatacgattgaaggtcttgtgcacgtcagctttatgacggatgattattaccgttttgacgagcagcatttcgccatgatcggcgaacgcacgggcaacgtttaccggatcggagacgaaatcacggtcaaagtcgtcgacgtcaataaagatgagagaaacatcgactttgaaattgtcggcatgaaaggcacccgccgtccgagagaaacgacaggcgaccgcagaaaacgcggcagaccggcgcggaaacgcgtgttaaacagcaataccccggcttcaccgccgaaatcggaggaaaaaggggaatggtttacaaaaccgaagaagaaaaagaaaaaacgcggtttccaaaacgcgccgaaacaaaaacgcaaaaagaagaagtaaatgcgaaaagcaaatggggcaaaatgctctgtttgctttctttcgcaagccgcattttcattgtcgcggaacgctccatttgctaaaataaagcgtatcgcacacatgaacggtttttgcggagagaggaggataaggcatgccaaaaggatcaggcaaagtattatcgcaaaacaaaaaagcaaaccatgattactttatagaagaaacctatgaaacaggcatcgtgctgcagggaacagagattaagtccatccgcgccggccgcgtaaacatgaaggattcctttgcgaaaatcgagcgcggcgaagtgttcctccacaacatgcacatcagcccgtacgagcagggaaaccgctataaccacgacccgctccggacgagaaagcttttgatgcacaggaaagaaatcaataagctgatcggcctgacaaaagagaaaggctattccctcgtgccgctgaagctgtatttgaaaaacggctttgccaaagtgctaatcggcctcggaaaagggaagaaaacatacgataaacgtgaagatttaaaacgaaaagacgccaaaagagaaatcgaaagagcgttcagagacagacaaaaaggcttctaatgcctgagccttgatgtgataactgccgtatgctatactgttcacacatcaaattcacaggctgtttattgaagacattcccaattgaatttgtctgtgatcatgatataataacagtacagccagttaagcaagagcttgatagatctcccgtatacccttaacaaggggacgttacggattcgacagggatggatcgagcttgagctgcgagccgagaggcgatctcgttaacacgcacctaaatataactggcaaaactaaaagttttaaccaaaacttagcactagctgcctaataaacgcagcgagctcttcctgacattgcctatgtgtccgtgaagagcacatccaagtaggctacgcttgcgttcccgtctgagaacgtaagaagagactgacagactagctctcggaaggcccgcccgcaggcacgaagacgagtgaaacacgaaatatgcaggctacgctcgtagacgcttaagtaatcgatgtttctggacgtgggttcgactcccaccgtctccatacataacagaggaaccgcagtgccgtcacttgaccgcactgcggttttttcatgccgaaataaaggagtccatttgaatgatagtcgtcattatagacggaaaagatattacaagcacagaagcattacaccgaatcttaaaagatcaattagatttcccggacttttatggcgaaaatctgaatgccttatgggattgtctgacaggctggatcgaatatccgctgactttggtgtggaagaattttgaggccagtcaaaaggcattgggttcggatgctgatgatgtattaaggatattataaaaggcgcaggcagagttagatggtgaatttttcattcaaattgagcagccgtcagccgggacaacggacaggcactaaaaagtgcgtacttcccctcatctatttttctatccgataatagggacggaaggtttcaggctttcgatttcagtccatatataagaagagacttgcgatagggaggaatggatgatggatttgcagttgaaagggaagacggcgcttgtgacgggatctacgtcaggcatcgggaaggcgattgcggcttcgctgattgcagaaggtgcggctgtgatcattaacggacgccgtgaagaaaaggtgaacgaaacgatccgggaactagagaaacagacgccggatgcccgtctctatccggccgcatttgatttaggcacggcggaaggatgcggcgcgatttttcagcagtatccggatgtggatattctcgtcaacaatttaggaatctttgaacctgcggaatactttgatattcctgacgaagagtggctccggtttttcgaggtgaatatcatgagcggcgtgaggctgacacgccggtatgcaaagcggatgattgaacggaaggaagggcgggtgatttttatcgcgagtgaagcggccgtcatgccttctcaggaaatggcccattacagcgctacgaaaacaacgcagctgtcgctgtcacgcagcctggccgaactcacggaagggacgaatgtgacggtgaatacggtcatgccgggctccacgaaaacagagggcgtcgaaacgatgctggagtcgctttatcccggtgaaaacctgacagcggctgaagcggagagacgatttatgaaggagaatcgtccgacgtcgatcattcagcggttgatccgtccggaagaaatcgctcactttgtcgcctttttaagcagcccgctgtcgtctgccattaacggatctgcattgcggatcgacggcggcttggtgcggagcattatataagatgaacgtacaaaaacccccgtaaagcgggggtttttttaatgcggatcacgctgaaaccggccgatgatcctgctgattaaatcttttgtggcagagtcaaaatgctcttctttctggtttgtcaacagcccgaccggcggtgaaattgttaagttacggatcggaatgaccttcgtgccctcgatcggttctgagtgcgccgtcgccgtaaagattgagacgccgatattttccctgacatagtattggtgagccatgctgctggtcagctccatttttcgatagcggctgccgatggcccgctgcaggtgctgttcaatttgaatccggatcgggcaattggcgggcgtgaaaatcaggcattcattttctaaatcctcgagattgacgcttgctttggcggcaaggggatgtctgtctgacacgatgacattgagcgagtcatgaaaaaacggatcgaaataattctccagaatcagctccggctcgccgcatacggcaaaatcaatggcgccctccagcagtttgcggctgcatgtattggcatcatccacgctgacattgaccgacatgtcaggataatcatttaagaacccccgcagtacggcagggaagatcaggcttgccgtcggttcggatatgccgatgtgaataaggccggcctggccctgtctgatgtcggccagagtatggtcaagcacctcgtattgcgcgagaagctgcccggcccgctcatgaaacagccgccccgcccttgtcagcttcagcttctttccccgttcaaacagctgagcgcccacatcctgttccagctgtttaatccgcattgaaatcgtcggctgtgagtagttcagaatttcggcggctttataaaagctgcctgactgtacgatcgtatgaaacgttttaatggtgcgtaattccaacgaaatcccctcccggctgttcattaattttcttgaacctttcctttactttttttgattagtcaaataaatcagtttgctttatagtataaacaatcaaagcttagtaaacaaattggaattatatatttttgcggggagagtgaccggaatgagtgaagacatatttcgattggctgagaaaaaggatgcaccggagtttttagagctgctgtacagcgcgtttcagccgatccgcaatttggagattgactggccgtcggcgcgggccgacatcgatatggtaacagaaaatattgaaaatcattcagccgtcgtgctcgaacgggacggacggattctttcaaccattacgatccgttttccgtgggagagtgacacgcctccgtcaaaatatccgtttgtctggtggtttgcaacgcttcctgagctgaaggggcagggcatcggcagcaaacttttgacttatgtggaggaacacgtgctgcgggatacgctgaaggccccggccatcacgctcggcacttcggcgcgcaagcatccctggcttgtagatatgtacagacggagggggtatgaagtgtattttgagcaggagaaagacggagacatcggagtcatgatgagaaaggtgctcataccggagcggtttgacgcgtcgctgttaggcacaccgagctgggcgcaatgataaaaaaacggatcagagccggctgtctgcttctgctgctcggtgtgctggccgggtgcgggcaaggagaaagcacaaaagcggggagcggcgtgcagaccgtcattgtcggcacgggaactgattttccgaacattgcttttatggatgaaaaaggcgagctgaccggctatgacattgaagtgataaaagccattgataaacagctgccgcaatacaaatttgtctttaagacgatggatttttcgaatctgcttacaagtctcggaaaccggaaaattgacgtgatcgcgcacaatatggcgaaaaataaggaacgggagaaacgctttttgtatcacaagatcccgtataactactcgccgatgtacatcacggtgaaggcggataatgacgcgatacacacgctccgggatttaaaagggaaaaccgtcatcgtcggcgcgacgtcaaacgcggcggattatatgacggcatacaacaaaacccacggcagcccgatacatttgaaatacgccgggcagggcagcaatgatacagcaaaccaaatggagacgggacgcgctgacgccaccgtatccacgccgtttgccgtcgattttcaaaataagacgcacgcgttcaaacaaaaaacggtcggtgatgtgctgctggataccgaggtgtattttatgttcaataaaaacagccaaaccctggcggacgatacggatcgggcgattcaaaagcttgagaaggacggcacattgaaaagactgagtgaaaaatggctcggcgcggattattcaaaatcaagtttcacgaaataattgaagcagaaaacggggcgatcacatgaaaataagattggcggtcatgtcattaacaattgccgcaacggcggcgttatcagcctgcggcgcgggagggggggcggcatcaggcaatcagaaaaacgtgaagaacattacggtcggcacgggaactcaatttccgaatatttgctttattgatgataaaggcaaattgacgggctacgacgttgagctggtgaaagagcttgataggcgcctgccggactatcgtttcacttttaaaacgatggatttctccaacctgcttgtcagcctcggccagcataaagtcgatatcgtagcccatcaaatggagaaaagcgccgaacgggagaaaaaatttctgttcaatcaagtcgcgtataacaacttcccgctgaaaatcacggtgcttcaagaaaacgggaacattcacggcattgatgacttgaaaggaaagcgggtcattacaagtccgacgtcaaacggcgcgcttgtgctgaaaaaatggaatgaaaaacacggcagtccgtttgaaattgcttatgccggccaaggctccaacgatgcggccaatcagctgaaatccggccgcgccgatgcgacgatttctacgccgtttgccgtcgatttccaaaacaaaacgagcgcgatcaaagaaaaaacagtcggcggggtgctgtcaaatgccaaagtgttctttatgtttaacaaaaatgaacaaacgctgagtgatgacattgataaagccctgcaggaaatcattgatgacggcacgcttaaaaagctgagtgaaaagtggctcggcgcggattattcaaaggagcaatattaagtgaaaaagagagggatcggcaatggaaaaagcgtttgatatcagtatgatcgcgtcctttgtgccgacattgctcgggtatttgcccgtcacgctgtatatattggcggtgtctctgctgttcggctttctattggggctgcttttggcgctgccccgcatctatcgcattcccgttttgaatcagtttgcgaagctgtatatctcttttttcagaggaacgcccatcatggtgcagctgtttattgtgttttacggtattccggcgctcacggcgctcgccggaattgatacctccaaaatggaccctttgtatgcggccatcgccacgtacgcgctgagcagcgcggcaagagcggccgaaatcatcaggggaggtgtgaacagcgtcgaccgcgggcaggcggaggctgctttcagcatcgggctgaacggggggcagacattccggcgcatcattctgccgcaggcgcttgtgcaggcctttcccaacatcggaaatatggtgatcggtttcttaaaagatacatcactcgctttttcgatcggggtgatggatatgtcgggcagaggacagaccttgattacatcgagcaatcattctttagaagtgtatatctcgctttctgttctgtattatgcggccgcccttttatttgaatgtgtcttcagatgggccgaaaaacgaatcaagaaagatgagacgcgccttgtaacggtttttgacatgagcgcgcacggctgaaaaggagggagaacagtggagctggatattccatttatcggcactgcgatcaaacaaatgatgaaaaccgttccgcttacattggcaatgacggtcattccgattattgccggatttttcatagctctcggcaatatcacggtgcgtatattccgcatcaaatggctgctggcctgctcatcgttttacgtgtcttttttccgcagcaccccggcgattctccatattatgctgatttatttaggggttccgctgattgccgatcaattcagccgcgcgtttcatctcggctggtcggccaatcagattccggtcgccgtgtttgtcatcatggcactgtcattaacggcaggcgcttatatgacggaaattctccgttccgggatcatggccgtcgatacggggcaggcggaggcggcatattcaatcggcttgacgcggggccagatgattcggcgcgtggttctgccgcaggcgttcatgatatcgctgccgaacttcaccaacataggcatcggctttttgcataccacttccatcgcggcaattgttgcggtgcctgaaattacaggaacggcgacgattgcggcatccgataactatgcatttctggaagcatttatcggggctgccgtgatttattggggattaacgctgattctcgaagctgtaaacagtctggcggaaaaaagggcggccagatatcaaggaggcgcattatgatcgaaatccgaaacattcagaaacattttggcagtcatcacgtgctaaaggggatcaatttaagtgtccggaaaggagaagtcgtgaccatcatcggcccgagcggttccgggaaaaccacttttctgcgctgccttaatttacttgagcggccggatgagggcgccatttcgctgcacggtgaagtcattaactgcaaaaagcctgccaaaaaagacattctcagactgaggaaacagacggcgatggtttttcagcaatatcatttgttttcgcataaaacggcgattcaaaatgttatggaaggcctgacggtcgcaaggaaaatgaaaaaaacagatgcgtacgccattgccgagcgggaactggccaaggtggggcttcaggataaattgaacgcctatccgaatcagctgtcgggaggccaaaagcagcgggtcggaattgccagggcgcttgccattcatcctgatgtgatgctgtttgatgaaccgaccgcagcccttgatccggagcttgtcggcgaggtgctcgaggtgatgcttaacattgtgcggaccggcgccaccatgatcattgtcacacatgaaatggaattcgccagaagagtgtccgaccgaattgtgtttatggatgaaggagcaatcgtggaacaaggaacgcctgaggaagtcttttacaagacgaaaaaagaaagaacgaagaagttcctccgccgcgtgctgcctgattacggttatgacataaaagagcgcataaaggagcctgtcgtatgattcgtttaagcattttagaccaaagtgtcaccgcggaaaaccaaaccgcagaagaagccttgcggcaaacggtgagattggctcaggaggccgaacaatacggatatgaccgtttctgggcggcggagcatcataacaatgaagagatagcgggatcagcgccggaaattgttctggggtatcttgccgcaagcacgaaaaaaatccgtctcgcgtccggcggggtgatgctgcagcattacagtccttataaagtggcagagcagttccgggttctgtccgctcttgctcccggccgtgtggcgcttggtgtcggcaaagcgcccggcggatttcagctgtcaaccgatgcgctgcagcgggagcttatccagcccgcccgtttatttgaagaaaagcttgaggagctgactcatttcatccgaaatgattttccggactcgcaccgctacgcgtcattgcggccggcgccgcatactgagtatgcgcctgacctctttttgctcggcggcagcgcggaaagcgcgatatccgcggccaaactcggcatttccttcgttttcgcctatttcataaacggtgaagaggctgcgttagaaaaagcgcgccacgcctttgacgagcatctgccgaaagggtctaaggcggaatttcaccttgcgccgatggtctttaccgcgcatacaaaagcagaagcggaaaaacacgtggtatcgcgtgagtcggtcaaaatcattctcgaagacggcaaaaaggtgaatgtcggttcccgggaacaagcggaagcgtttcttgaacaagtcacgcagccatacaagctgattacacaaaagacgggtgtgattgccgggacaaaagaagagactgccgccgagctgcgacgattatccgttccgtacagcattactgattttgtgattttgtcgcctatcaaaaacgctgaggaaaaacgattgtcttaccggctgttaagcgaagcggtgcagccggccccacaattataggagggatgaacatgagtcatgaagtaaacgtagtggtctggagcaaacagggctgctcctattgcgatgaagtgaaaggatatttgcgggaaaatgccgttgcatacgaaacaattgatgtgacagagcgggacgaattgagtgacgtgctgcagacgaagtacggcatccgtcatgttcccgtcgttgaaatcggcagcggtgacagccgtgtgtatcaggccgttactcaagtcggcattgaacatgtagaacgggcgcttgctgattacgaggggaaaaagggggagagaaaatgagccggacagatcttattcaattcggagccatgattcacggtgtcggcggcacaacggacggctggcgtcatcccgacgccgatccgacagcaagcacgaatgcggcgttttacaggcaaaaagcgcagactgctgaaagagggctgttcagctttgcttttattgcggacggcttgttcatttctgaaaagtccatcccgcatttcttaaatcggtttgagccgatcactatcttatcggcgcttgccgcctctacaacccatcttggtttaatcggcacattttccacatcgttcactgagccgttcaccatcgcaagacagctgatgtctcttgaccatatcagcggcggccgggcgggctggaatctcgtcacctctccgcaggcgggagccgcgcgcaatcacagcaaagaaagccttcccgaccacagccggcgctatgccatcgcccaggaacatgtggacgtggtgcgcggtctgtggaattcctgggaagaagatgccttcgtccgcaacaaagaaaccgggcagttttttgaccctgacaaactgcatcgcctgtatcacaaaggcgagtattttcaagtggagggcccgctgaatatcggccggtccaaacagggagagccggtcgttttccaagcggggtcttcagaaaccggccggtcgtttgccgcgaggaatgcagatgcagtctttacgcactccaattcacttgaggaaacgaaagctttttatgatgatgtgaagaagcgggcggcggattacggccgggacgctaccaagctgcggatctttccgggaatcagtccgattatagccggctcacaagaagaagcggaagcgaaataccaagaattcgccgagctgattccgatagagaacgccgttaaatatgtggccagattttttgacgattatgatctgagccgttttccgctggatgagccgtttcctgatttgggcgacgtcgggaaaaacgcgtttcaaagcacgacagaccgtatcaaaagggaggcgaaagcccggaatcttacgctgcgtcaagtggcgcgcgaagccgcgtttccgcgaacccattttatcggcacaccggaacatgtggcatcattaattgaaacatggtttcagcgggaagcggcggacgggtttatcattcactctgacatccccggcatgcttgaagcttttgtggatcatgtcataccgatcctccaggaaaaggggctgtaccgaaaaagctatccggcggatacactgcgggggaatctcgggttggatattccggtctgtaaatcaaatccgatgttgagcagaaactaaatgtttctgctttttctgctgcttgccattcccgtcattacagccttttcaaaaaaatacactgatttcgagatattattgttgcgaaaagatttttttgtaactataattattacagaactgatcagtataaaaaaacattcatatttcataataaatgtgtgtgtaatctgaaaacgaaagggctgtttacaatggcaaaagtactttatatcactgctcatcctcatgatgaaaagacatcttacagcatggcgacaggaaaagcgtttatcgattcttataaagaatcaaacccgaatgatgaggttgtacatatcgacctttacaaagagaacattcctcatatcgatgcggatgtattcagcggctggggaaaacttcaatccggcacaggttttgaagagctttctgaaaacgaaaaagcgaaagtcggccgtctgaacgagctgagcgatcaattcgcgtcagctgacaaatacgtattcgtcacaccactttggaacttctcattcccgcctgttatgaaagcgtaccttgattctgtggctgtagccggaaaatcattcaaatatacagagcaaggcccgatcggtctgttgacagacaaaaaagcgctccatattcaggcgcgcggaggctattactctgaaggaccggcggctgatatggaaatgggccaccgttacatcggcatcatgatgaacttcttcggcgttccttcttttgacggattaatcgttgaaggccataatgctgaaccgaataaagcacagcaaattaaagaagatgcgattgcccgcgcgaaagaagccggaaaatcattctgatcttaaaaaaacctccccgccgtacggctgggaggtttttcatattaaagggcaatcgtccgtttttgttcgctgcttttcatcgccgcttcaatgacacggatgacatcgatgccttcttttgccgtaacgggaagcggttttccgtttaagatgctgtctgccagcagtttgtagtacgtaaggtaagagccgttctcagaggggattgtttctgtatgccgtttttcatccgctgcgattgtcagttctccgaagttgtcagggtcatcggcgccccagctctcgtcaatcggcttttgtccggctgaaagcgcatcttcctgtccatccattccgtatttgataaagcttgcattccgtccgtgaatctgatagcgcgggccgcttgccgcattcatggagccggattgaagaatgacctgaagtttgccgtaatggagcgcggccagaaaattatcaacggtttcactgttgtcccgctgtttcatcacatgtgcggtgacggattccggcattccgaaaagcagaagtgtctggtcaataatatgtgaaccgagatcatacagcgttcccgtggcgggtccgttcatttcgcgccatttttcctgtacaaccgggttgtatagatcgtagctgacttgatatgtatgaatgtcttgaagcgccccgtcccgaatcagcttttgtatcgttaaaaagtcattgtcccagcgccggttgtgatacacgctcagcaagacgcctttattttcagccgttcttctcagctcctccgcttctgctgaagtcgccgtcatcggtttttccacgacggtgtgttttcccgccaggagacatttcatcgctgattcataatgcattccgctcggtgtcgtgacgatgacgagatcaatgtcaggatcaccggtaatgtcttcaatcgcgcgcacggcttcagcccccggcagatcacgtttgacctcatccgttctggacgtcatgacttttttgatctgataatcatcaaggacgtccaaaagcggcgcatgaaagactttacccgacaaaccatatcccaatatgccaacttgtatcgttttcaatgaatttccccctcttgatatgtgataacattatataccccgcgggtgtactggtaaaacttgtgtgttgaaaattttttacaccggattttcaagtctgtataatgaagataacgaagaaaaaaaccgaggtggaaaatggacaaacataccgagcatcaatcgttaaatcataaaagcgccaaagaaaaagaccagatcctgaaccggctgaaacggattgaaggccaagtcaggggcattcagaatatggtggataacgaacgatactgcgtggatattctcgtacagatttcagccgtacaggcggccatgcagaaagtcgcgtttcatctgctggaagatcacgcccatcactgcgtagccggcgccattgagagcggaaacggggagcaggcgattgccgagcttcttgatgttgtgaaaaaaatcgcaaaatcgtaaaataaaatgttttgaaataccctacaggggtatggtaacatgaagaagaaaaaacaagacgtggagggaatcatcatggaacaaaaaacactgcaagtcgaaggcatgtcctgtcagcactgcgtcaaagcagtagagaccggagtaggagaactgaacggagtgacggcggttcaggtgaaattggaagccggacaggtggatgtgacgtttgatgagaacaaagtctccgtatcagatataaaagacgcgattgaagatcaaggttatgacgtcgtataggatttatcgcgctgcggaaacgggcgcggttttcttttatcatacttatacccccatggggtttatgaagagagatgaggacattgagtgaaccgaaagaaatgaccattcaagtggggggcatgacatgcgccgcctgcgcttctagaattgaaaaaggactgaaacggatggacggcgtcaatgacgcttccgtcaatcttgcgcttgagacctcaaatatttcctatcagcctgacaaaatcgaagctggcgccataaaggataaaattgaaaaactcggctaccatgttgtgacggaaaaagccgagtttcagattgaaggcatgacgtgcgccgcttgcgccaatcggattgaaaagcgcctgaacaaaacagagggcgttgtgggcgcgccggtgaatttcgcccttgaaacggtcaccgttgaatacaatccgaaagaggtgacaccgaaagagctgaaagagaccgtggcaaaactcggctacagattagacgagaagcaagcggttgatggaggcggcggattatcccaaaaggagaaagagcagcgaaaacagctgatcaggctgatattttctgccgttctctcatttccgcttctatggtcgatggtcagccatttttcttttacttcttttatctggatgccggatatcctgatgaatccgtggctgcaattcgcgcttgccaccccggtgcagctcgtcatcggctggcctttttatatgggagcgtataaggcgctgagaaacaaaagcgccaatatggatgttctcgttgcgctcggaacgacggccgcttacgcatacagcctgtacatgacgattgcgtctctcggacgagacggacatgtagaggggctttattatgaaacgagcgccattttgctgactttgattttgcttggaaagcttttagagatgaaagcgaaaggccgctcatcagaagcgattaaaaagttaatgaagcttcaggcgaagacggcggcggttgagcgggaagggaaggtacaggtgattccgattgacgaggtccggacgggggatatcgtatatgtgaaaccgggagaacgtgttcctgtcgatggcgaagtgattgaaggccattccgcaattgatgaatcgatgattacgggggagagcatgcctgtcgataagtctcccggaagcaccgtcaccggggcgacgatcaatgcaaacggctttctcaaaatcagagcggtgaatgtcgggaaagataccgcgcttgcacacattattaaaatcgtggaagaagcccaaggatcaaaagcccccattcagcggctcgcagatcacatttcaggcattttcgtcccgattgtgctggggctggccgtgctgacttttctcatttggtatgtatgggcggcgccgggacagttttctgaagcgatcggcaaattcatcgccgtgcttgtcattgcctgtccgtgcgcactcgggctcgccactccgacgagcattatggcgggctccggccgcgcagctgaattcggcattctttttaaaggcggagagcatttagaaaaaacacagcgtctgacgaccatcgtactggataaaacaggaacggtgacaaacggcagaccggttctgacagatgccgtaccggcagagggaatgaacgaagaggaactcctgcggctggcggcggccgccgaaacgggatcagagcacccgcttggagaagccatcgtgtcaggagccgaaaaacgggggattgccatcccaaaaatcacccggttccaagcccggatcggttcgggaatatacgccgaggctgacggcagaacgattcttgccggatcaagacggctgatggaatcagaacacatcgaacatgaggcgctgcttcctcacatggcccgcttggaggcggaaggaaaaacggtgatgcttattgcggcagacggcaaagcggcggggcttatcgcagtcgccgatacaatcaaagacacatctccggccgcggtgaaacgcctgaatgatatggggcttgacgtcatcatgatgaccggtgacaacaaaaagaccgcggaagccattgcaaaagccgcgggcatcggcagcgtgatcgccgaagtgcttcccgaacaaaaggcggcggaaatttcccggctgcaaaaagaaggccggcgcgtggcgatggtcggtgacggcatcaatgatgctccggcgctggctgtggccgatatcggaatggccatcggcaccggcacagatatcgcaatggaagcggcggatattacgctgatccgcggtgacctgaacggcattgccgacgccatcggcatgagcaggctgaccatgagaaacatcaagcagaatttaggctgggcattgggatacaacagcatcggcattccgattgcggcggccggctttctggccccgtgggtggcaggcgctgccatggcgttcagctcagtatcggtcgtccttaatgctttgcgtttacagaaggtaaaaaaagacaaaatgggctgatgcctgttttgtcttttttattgacactttattcaaagcctgcatataatagagaaaacaaatatatgagtatatgttcatatatataaattcgtttagctgtattgatgttatgggaatcctattacggaaagtagggtgagtcgaaaatgaaagcagccaaaggtgaatttgtattagacggacttgattgcagcaactgtgcaaaaaaaatagaaaacggcgtaaaagccattgacggcatagacggctgtgctgtcaattttgcggcaagcaccatcacggtctcagccggcggcaaaaacgagcaatggatgaaagatgaggttgcgaaaaaagtaaagtccattgatcctcatgtgaccgttcgttcgaagcacgaagacaaacccggcgaggatgaataccgcaaaaagctgcagctgatgttagtgaggttggctgcgggagccgttttggccgtcatcgcttacttcgcgcacacgggcgccgtccttgagtttctgctcttttttgcttcgtatttgatcatcggcggcgatatcgtagccagagcgggaaaaaacattgtccgcggccaggtatttgatgagcattttctgatggcgcttgccacgatcggcgcatttatgattcatcaatatccggaaggcgtcgcggtcatgctgttctaccaaatcggtgaactgtttcagggagcggccgtcagccgatccagaaaatcgatcagcgcgttattggacatccgtcctgagtacgccaatgtgaaaacggaaaacggcatgactgccgttccgccgcaggacgtcaaagtcggacaggtcatcgtcgtgaatcccggagaacggattccgttggacggaaaggtgctgagcggttcttcgatggttgatacatccgctttaacgggcgaatccgtgccaagaaaagcggagccggggcaagatgtgatggccggatttatgaatcagaacggcgtgcttcatattgaaacctctaaaggatatgaagactctgccgtgtcaaaaatattggatctggtcgaaaatgcggccggacgcaaagcgaaaacggaaaactttattacgaagtttgccaagtattatacaccggccgttgtcattgttgcggtgcttctcgcctttttaccgccgcttctcgtgccttcagccgcgctatccgactgggtgtaccgcgcgctgattttccttgtgatttcttgtccgtgcgcactcgtcgtctccattccgctcgggtttttcggcggtatcggagctgcgtctaaagcaggggtgctcgtgaaaggcagcaactatttagaagcgctcaatcaggtggcatacgccgtgtttgataaaacgggaaccttaacgaaagggaatttcgccgttactgatatcaaaccggcggcagggtttacgaaagacagcctgcttcatgcggccgcgcttgcagaagcccattccaatcatccgattgcttcttccatccgtgaagcttacaatcaaccgctctcggctgaggagattgaagaatatgaagaaatacccggacacggcattcgggtgaaaaccggcggatcaacgattttagccggaaatcaaaaactgatggcaaaagaacaaatcgcttccggtacagctgaaaacaacggaaccgtcgtctatgtcgccgttgatcagcagtatgcgggggcgatcgtgatcgccgatgaaatcaaagaggacgccaaacaggccattgccaatttaaaagcgctcggcgtgaagcggacagtgatgctgacgggtgattcaaagcagaccggagaagctgtcggccgagagctcggtattgatgacgtgtacacagagcttttgccgggtgacaaggtagaccgcgtcgaagaacttgaagcggcgcttttaccgaatgaaaaactgatgtttgtcggcgacgggattaatgatacgcctgtgcttgccagagctgacatcggagctgccatgggggctctcggctctgatgccgccgtcgaagcggccgatgtcgtcctgatgacagaccagccgtcaaaagcagccgaagccatccggattgcacgccgaacacgccggatcgtctggcagaacatcggatttgctttaggcgtaaaaatcatttttctcctgcttggcgcattcggattcgccaccatgtgggaagcggtcttttcagatgtaggcgtcacgctgatcgccgttgccaacgcgatgcgcgtcatgagagtgaaagcggaataattgtcaaagataattcgtttttcagggttttcttaaacaaggttgtcttggtaaaatagagaagcgggccatccggcatccgcttcttttttattttaaaaacaatgaggtgtctgagtgaaaaagaaacaatcgtctgcgaaatttgcggtgattctgacgttaatcgttgtcgttttatttgcggccatcgtaattattaacaaccaaacggaaaaagcgggcgaaacagtcgccgaacagccttccattaaaggacagcccgtgctcggcaaagacagcgcccctgttacggtagttgaattcggagattacaagtgtccgtcatgcaaagtatttaacagcgatatctttccgaaaatcaaaaaagattttatcgataaaggcgacgtgaaattttcatttgtgaacgtcatgtaccacggaagcggctcgcgtctggcggctcttgcttcagaagaagtgtggaaagaagacccggcatcattctgggcattccatgaaaagctgtttgaacagcagccgtcaagcgaacaggaatgggtcacgcctgcattgcttgaaaaaacggtcaaaagcaccgcgaaaaaggttgatcctgacaagctgaaggaaaaccttgataaagagacatttgcaaaagagctgaaagctgacactgacctgaatgataaattaaacattacggcgacaccgacgatttacgtaaatgacaaagtgattaatgacttctctaaatatgaggagatttcaaaaacgattaagaaagagctgaaaaatgaaaaatagaatcgtatttttatatgcttcttgggtgattgctcttgctgctatgctcggcagcctttatttcagcgagatcagaaaattcataccgtgcgagctgtgctggtatcaaagaattctcatgtacccgcttgtcctgattttaggaatcgccaccttccagggtgacacgcgcgtgaaaaaatacgtgctgccgatggccgtcatcggcgcgtttatatcgatcatgcattaccttgagcagaaggtgcccggtttcagcggcatcaagccgtgtgtctacggcgtgccttgctcatctgaatatattaactggttcggtttcattaccattcctttcctggcattgacggcatttattctcattattatctgcatgtgttttgtcaaaacggaacgcacggcaaaataaagagcctgctccatgggagcggctctttttctattatttgtaccaagctttgtttgtcgcaatctgtctgttatgggagctgtcccaaatatccacggaataggcataatcataattcatgacgcagcggatgccgctgccttgggcgtcatgctgaagtccgaagttatgggaaaactcgtgctgtgccgctttcgccgtgttggccgttccttgatcaaggttcacgctgaaagccgggccgctcggtttgccgttatatacatacgcgataccgccggcgtcaaaacttgattttgcggtaaaaccgacgacaaaatgataattttgatttctgaagctgccttggagattcgataaaatctgagaactgtttgagccggaggaattccaagcctgcacggcctgtacgacgaaatcaatgttgtgatcacggttaaaagcaacatccgcctgctccacgatctggacgattcgcgtttgccagtcgctgtatttggcgcggtattcagcgtccgccaccgccagcactctgaccttctggctgcccgtgctggctttagttgaggctttatcctgactgacattggcattgaatcgtttcgtgccgacctgcttgccgttttcatccagaatttttgtgtcaaccgtctgttcgacttggaccgggcccttcagatctttaaaatgatcggctttcggaagcgggtccgtatacaccgttttcgccggctccgcatgagtgtgcgaatgcgtatggctttcggctgacggcaggccgggaattaatccggcggccaataaaacaggaaaaacaagtgaactgattttcatctcataaccccctttttgttagagaaagtattcaatgaaacttccaataaacctcccaaaatagtataaaataggtaaatgttcttgctcccagccgttgcgagtgaggttgtcccggattaggaatcagaatctttcaaaaataaggttgattttaagagaaagcgattataaaatctaatggtcgtcagaaaatttaacaaataaaaaggagcatatggaatggcctgggagctgcttagtgtaatcggcatcattgcgtttgcggtcagcggagcgattgttgcgatggaagaggagtatgatattttaggcgtgtatatcttggggattgtaacggcgttcggcggaggagcgatccgaaatctgctgattggtgttccggtctccgccttgtgggagcaaggcgcgttttttcaaatcgctctcgcatcagttacgattgtctttttgtttccgaagctgctgttaaggcattggagtaaatggggcaacctatccgatgccatcgggctttcggcgtttgccatccaaggtgctttatatgccgtgaaaatgggccatccgctcagtgcggtgattgcggcagcggtcctcaccggcagcgggggcggcatcatacgggatttgctcgcgggcaggaagccgcttgtgctcaaggcggaaatttacgcggtctgggccgcgctcggagggttaatcgtgggcctcggctgggccggggatgccgccggtttgtatgtgctgtttcttgtgcttgtggcatgccgcatctgcagttatgtgttcaggtggcgcctgccgaatcgttcctatcatatagatcagtaaaaaaccgatttcataaagaaatcggttttttttcataacggcttctgataaaaaaagacgcccgatatgataagaaaaagggtatttgaccataatgctgaataatatgttgcatatatgtttgtaagatgaaagccggatttgtcagcttgatgtcggaggtgccgctgatggcaaaacgtgataaagagtggaaagaagagcaggaaagactcaattttgtcatgaaggaactggaacagaaacaaactcatcttgaagcctcatcgggcggattgaagcaggatattgtcgggctgagaaaaacgttttgggatgatgtcaccgtgaatatggatgatgcccatgaagcggctgagacattttcaagcattaaacagcaggcggaaatgctttcagaacgtgaacggacgcatcggcttcaataccggcagcttcaaaaaatccaaaagctgaaaacctctccttacttcggccgtgtcgattttacggaaaaaggggagtcctcttccgagcggatttatatcgggctgacttctttgatggatgaaaacaacgagcaatttctcatttatgattggcgcgcgcccatctcatctctttactatcaatattccccgggaaaagcccgctatgaagttcccgaagaaacgatagaaggagacatcacactgaagcggcagtttatcattaaaaacgggacgcttaaagcgatgtttaacacggatatgacgattggtgacgaaatgctgcaagaggtgctgagcgggcattccggacagcatatgaaaaacatcgtgtcaaccatccaaaaagaacagaacgaaatcatccgggatgaaaaaagcaaatatctcatcgttcagggagccgccggaagcggaaaaacatccgcggcgcttcagcgggccgcttacttgctgtaccgcggtcgcggggtgcttgatgcccgtcagattgtattgttttccccgaacattttgttcaacagttatgtttccgccgtattgccggaattgggagaagagaatatggagcaggccacctttcaggaatatatcctccgccggctcggacgaaagtttgattgtgaaagcccgtacgagcagcttgaatattgcctgactgaacaaaatcaggacgtacttttcgtaaggctcgcagccattgcttacaaagcgtcaccagctttccaggccctgattgaccgttatgccggatcgctttcggtctccggcctgatgtgtaaacagatcagcttccggggagacatcctgatttcaaaagagcggattgaagcctatttttattcgcttgatcagcagctgccgattccgaacagagcggagctgacggcggaatggcttctcgcggaaatcagcgctctcgaaaaaaaggagcgtaagaaggaatgggtcttgcaggagagcgagctgcttgataaggaagactatgctgaggtttatcaaacactcaagaagcaggcggcagatgatgaacctgcatttgacgaccatcagcgcgaacagcggctgcttggcgccattattgtcggcaaagcctttaaaccgattaagcaggccgtcagacggctcggctttctcgatataaaacggatgtatctccggctgttttcagattggggagctgatgaaaagcccgatcattgggagagcatcggcgctttgaccagaaacgcatttgcagaacggtcacttccgtatgaagatgccgctccgtatctgtatttgcaggatctgttagaaggaaaaagaaaaaacacacaaatgaagcacgtcttcattgatgaagctcaggattattccccgtttcagctcacgtatattcaaagcatcttcccggcggcaaagatgacggtgctcggtgatgtcagccagtcgatttatgcccacaccattacgggcccttcttccctcgccggctgctttcgcaatggtgcagaaaagtatgtcagcctgaagcggacttacagatcgacgcggcagattgttgaatttacgaaagcgctgctggctgacggcgatgacattgagccttttaaccggaacggggaaaaaccgcgtgttttgcggacggatacagaaaatgcgcggcaggaacaattggcggatacaatccgggagctcagacaaaaaggctgggagacggtcgccgtcatctgcaaaacggccgcggaagccaaaaaagtgtttcaggcagtcagcgccgagagcggtgtccgcttgatcaataaagaaaaccagccttttcaaaaaggggtatgcgtcattcccgtttatttggcaaaaggcattgagtttgacgccgtcattgccgctgacgcctctgctgtccagtacaaaagcgaacatgaccgtaagctgttatatacggcctgtacgcgggcgatgcatcatctgaccgttttgtctccgggagaaccctctccttttataaaagaagtgcccgccggcttattcgtgtaagccctttgccaagtgcaaagggctttttatcattaggaatcttaatcattgtcatcatgattatatattttacttacatacaaactttcggtaaagtttcaattagaatattattttgacaattcctatagaaataacgtacgttacgtttaattccttgtgaggtggatatcgttgcaacttcaggtcatgaacagtccgtttaatcaggagcaggcagagctccttaaccgccttctgccgaccttgacagaatcacagaaaatctggctgagcggttatttggctgcggcccggtccgaatccggtgaaacagccgcacccgctgctccggctcctgcagaaagcccggcagtctcgaaagaagtgaccgtattatacggatcgcaaacgggaaatgcggaaggtcttgcgaaacagacggtaaagacgcttgaggaacggggattccaggtcaccgtcgcgtcgatgaacgattttaagctgaataatctgaaaaaagtaaacaatttattgatcgtggtgagcacgcacggagaaggcgatccgccggataacgcgctggcctttcatgaatttcttcacggcagacgcgcaccgaagcttgaagtgctccgttactccgttttggcgctcggggacagctcgtatgaatttttctgccagaccggcaaagagtttgacgagcgtcttcaagagctcggcggcacccagcttgcgccgcgggttgattgcgatcttgattatgatgagccgttttctgaatggcttgacgcggtcatcggcggtttgaacgaaggagcgggaaatcaaacagccgaagcgcctgccgagacgccggctctcggtgaatccgtttattccagaacgaacccgtttcgggcggaggttcttgagaacatcaatctgaacggacgcggttcgaataaagaaacacgccatctcgagctttcgcttgaagggtcgggcctcgcgtatcagcccggagacagcctcggcatctatccggaaaatgatccggcgctcgttgatgagctgatcaatgagctgaaatgggacccaaaacaggaagtggcggtgaataaacaaggagagcgcctcccgctgaaagatgcgcttacttctcattttgaaataaccgtcttaacaaaaccgttcctgcaaaaggccgcacagtttacggctgaccaaaagctgagtgaacttttggccgaaggaaacgaagagcagctgaaagcgtacatcaacggccgtgatctgcttgatctcgtccgggatttcgggccgtgggaagcgacagcggaagactttctttccatcctgcgtaaaatgccggcccggctctattcgatcgcaagcagtttagaagcgaatccggaagaggtgcatctgacaatcggagcggtcagatatgacgcgcacggcagagaacgaaaaggcgtctgcagcattctgtgtgcggaaagactccagccgggagatacgcttccgatttacattcagcacaaccaaaacttcaagctgccggacaatccggatacaccggtcattatggtcgggccggggacaggcatcgcgccgttccgttcctttatgcaggagcgtgaagaaaccggagctgaagggaaaacatggctgtttttcggggatcagcactttgtcactgattttctgtaccagacggaatggcaaaaatggctgcaaaacggtgttctcacaaaaatggacgtcgctttttcccgggattcggaggaaaaagtatatgtgcagcaccgcatgaaagaacaaagcaaagagctttatgaatggctgcagcagggagccgccgtatacatctgcggtgatgaacagcatatggcgcatgacgtgcaccaggcgcttctcgatatcattcaggaagaaggcggcatgagccgtgaaaaagcggaaagcttcctggcagacatgcagcagaaaaaacgctatcagcgtgacgtatattgattttggtttgaaaggagcttattcagcatggtgaacaacattttaaaagcgccggaaggccctccaagtgatgttgaggaaattaaagaaaaaagtgattatttgcgcggcacattgaaagaagtcatgctcgaccggatttcagccggcatcccggacgatgacaaccggctgatgaagcatcacggaagctacttgcaggatgaccgcgatctccgtaatgaacgtcaaaaacaaaagcttgaaccggcttatcagttcatgctgcgcgtccggatgccaggcggcgtgtcaactccggaacaatggcttgtcatggatgaactggcgcaaaaatacggaaacaatacattgaagctgacaacgcgtgaaacgttccaaatgcacggaattttaaaatggaacatgaaaaaaacgattcagaaaatcaatgcggcgctgcttgataccattgcggcctgcggagatgtcaaccgaaacgtcatgtgcgcttcaaattcgcaccagtctgaaattcatgcggaagtatacgaatggtcgaagaaattgagcgatgaccttcttccgcgcacgagagcctatcatgaaatctggcttgatgaggaacgtgtggcgggcactcctgacacggaaacggaaccgatgtacgggccgctgtacctgccgcggaaattcaaaatcggaatcgccgtgcctccgtccaatgatatcgatgtcttttctcaagatctcggcttcattgccatcgtggaggaaggccgtcttatcggattcaacgttgcaatcggcggcggtatgggaatgacgcacggcgatacggccacttatccgcagctttcaaaagtcatcggcttctgcaaaccggagcagctgtatgatgtagcggaaaaaaccattacgattcagcgcgattacggaaaccgttccgtcagaaagaatgccagattcaagtacaccgttgaccgtctcgggctggaaaacgtaaaagccgagctggaaaaccgcctcggctggcagctggatgaagcgaaaccttatcattttgaccataacggcgaccgttacggatgggtgaagggtgtaaaaggtaaatggcactttacgatgtttatcgaaggcggccgcgtcacggactatgagaattataagctgatgacgggattacgtgaaatcgccaaagtccatacgggagatttccgtctcacctctaatcaaaacctgattatcggcaatgtctcgagccagaaaaagaaacaaatcagcgcattaatcgaacaatacggtctgacagacggccggcagcattccgccctccgccgcagttcaatggcttgcgtcgcgcttccgacatgcgggctcgccatggccgaagccgagcgctatctgccgaaattgattgataagattgaagacattgttgacgaaaacgggctgcgggatgaagaaatcaccatccgtatgaccgggtgcccgaatggctgcgcccgccatgcgctcggcgaaatcggatttatcggaaaggcgcccggaaaatataatatgtatttaggagcggcgtttgacggcagccgtttgagcaaaatgtaccgggaaaatatcggtgaagaggaaattctgaatgagcttcgcaccattctcccgcgctacgcgaaagagcgtgaggaaggcgaacacttcggcgatttcgtcatccgcgccggcatcattaaagcgacgacagacggcacgaattttcacgaataagatgagcacttaaaaccaaggatagagacacactgacggtgcgttctctatcctttactaagcagcataaacgctgcaccgcgtcatgaaacagatgacgcagcttgcgaaaaagcctgttttcagagaaaacaggctttttctttttctagaaaaaatgtagctgaaggcaaaaaaagttcgccgtgagcacgttatgagaaattttaaataaaaacgggtaaaataaaagaagaatggttgcgtgcggaaaatatattgaatctgcccgatcatcggctccggcctttggcaaaggcagagaacaggcaataatgatatgatgcagcagatgaaggaggtcatgctttggacatatttttagtcgtactcgtacttttaaccatcatcgcgatctcaaatatcgtaaatcggtttgtcccctttatcccggtgcctttgattcaggtggcgctcggtatcattgcggcgtcatttccgcagggacttcattttgaactgaataccgaattgttttttgttttgtttatcgctccgctgctttttaacgatggaaaacggacgccgcgtgcggaactttggaatttaagagcgccgattctgctgcttgcgctcgggctcgtgtttgccacggtgattgtcggcggttacacgattcattggatgattccgagcattccgctggctgccgcgttcgggctggcggcgattctgtcaccgactgacgttgtcgcggtcagcgcgctgtcagggcgagtgaagatgccaaaaggcattctgcgtctccttgaaggagaaggactgatgaatgacgcatccggcctggtcgcttttaaatttgcgattgcggctgccgtgacgggcgcattttcgctggcgcaggccgccttcagtttcgttctgatttcagccggcggtttactcagcggtgtcgtcatttcttttttgattatccgtttccggctgtttttgcgccgcctcggcatgcaggatgtcacgatgcatatgctgattcaaattctgacgccgttcgtcatctatctcgcggctgaagaaatcggcgtttccggcattttagctgttgtggccggcggcatcacgcatgcggtggagcaggaccgtcttgaatcaacgatggtcaaattgcaaatcgtctcttcaagtacgtggaatattattttgttcattctgaacggtcttgttttcgttattttaggtgcgcaaataccggatgtggtttctgtcatctttaatgataccgcgtttaacaatatgatggtcatcgggtacattatcgtcattacgctgacgttaatgattctcaggtttttgtgggtgctgtttttttggaacggcaagtggttttttaacaaggatcagagcatttataaacccggcctgcgctcgaccctgctgatttcggtttcaggcgtcaggggagcggtcacgcttgcgggttccttttccattccttacgtgctctctgacggctcaccgtttcctgaacggaatttgattctctttttagccgcgggtgttattatgtgcacattggtgctggcgacaatcgtactgccgattttgacagataagccggaagacaatgtgaaagagaagaaagtcaaattgctgacagcgagacggaagctgataaaagctgccttaaccgccattaaagaaaatatgaatgagacaaacaaaacggcttcttttgcggtcattgccgaatacaatgagaaaatgaaaaatctcagatttcagcagttcaccgtcaaaaaccgcacgaaaaaagatgagcggaaagtccgcgcccaagggatacaggctgaacaggaagaattgctgcggctgattgagcggggcgacataccggaagaaacggctgacagccttcaggaacggtttgatgaactggaagtgctgtatacgaatccgtttaaagtcggcttatctaagaaaaagctgaaacgcctgatgtactggatctttttcggtgaacataaaaagccggaaatgacgattttaaatgaagaaggcctcatccgcgccacaagggttaaaacggcaaaagcggccattgaaagcctgaaaaaacacatgaccgaagaaaataaagatgtgacgcttgccgtcatttccttttacaatcacctgattttcaggctggggcactcgtatcacgaacagaatccgagccgccgttttgaaaatcaaaaactcgaaatcaaactgcgggccgtgcaggccatccgcaatgaaatccaaacattattcgaagagcgggaaatttcccgggacatgtcacatgagcttcgccagtacattaatgatgtggaagcggcaatgcttgacggaggagaataaaaaaagtccggcgcacaaggcgccggctttttttgcatattacggccgatggaattcaactgaattgccgtcgcggtcaaaccagcctctgaaggcccagttgatccagccgccatcacctttattggtgaagcttccgtcttcaaacacccaaatgccgtacgtgatgccgtcataaacggcggaaccgtaaaactgaacgccgttaaaatgatcttcatattcctggcttaaattaaacaccatgacgttatatttttgtccggaagcgtagaatgaagattccattaagtttttgacgaagccgtcacggttttgcgccgacttaatcgcgtcagcaatcgaattgccgatgccgagcaggtcaacgtcaatgtttaatccgacatcttttgctgagacatctgatgattgctgtgccatgttttgagggaccggggtttcttttgcggatacaaaggacagaggagtcagagacaaagcggcgccaagggcaacggacatcgggatacgcatacgtttcatatgatttcctccttcaattgtgtggtggctacagtagcgatttacccggacagttacccggctaaccggaatttttgaaaaataggaaaataataacggaagtggtgcttgggcactaaagatggtttttgtgacgacgatgagcgtataattggtttcttacggcggaaatgtgagataataataaccgtttacataatgactagaaaggatggttcaacgtggcaaaaagcttaaaagatactgtaaagcttcataatggcgttgaaatgccgtggttcggccttggcgtcttcaaggtggaaaacggaagcgtagcggcggactccgtcgaagcggcaatcagaaacggctaccgcagcattgatacggcggctatttacaaaaatgaagagggtgtcggcgaaggcatcagagctgcgggcgttgcaagagaagaactgttcatcacgtcaaaagtgtggaatgaagatcaaggatacgaaacgacacttgacgcgtttgagaaaagccttgagcgcctcggcctcgattacctcgatctgtacctgattcactggccgggcaaggataaatataaagacacatggcgcgctcttgaaaagctgtacaaagacggcaaaatccgcgccatcggcgtcagcaacttccaagtgcatcatttagaagagctgctgaaagatgctgaaatcaagccgatggtcaaccagattgaattccacccgcgcctgactcaaaaagaagtaagagatttctgcaaagcgcagggcattcaagtggaagcttggtctccattgatgcagggacagctcctcgataacgaagtgctgtcacaaattgcggaaaaacataacaaatcggttgctcaagtgattttgcgctgggatcttcaaaacgaagtcgttaccattccgaaatcgattaaagagcaccgcatcatagaaaatgccgatatttttgatttcgaactgtcacaggaagaaatggaaaagatcagcgcattgaacaaagacgagcgtgtcggcccgaatccggacgagcttctgttctaagaaaaaacagccctttacggggctgtttttctttacataaatgtctgtgtctgacgttttacgctgaacctgtatgcggctattaataacagggcggcggcgaaggctcccaaaatgatgatgttcagcatcaggctttggaacgtgcggccttgctgcaattgatccaccgtatcgagcacccagcgctgaggcagaaattcggcgattgtctgcaccgttttcggcataatattgcccggaaagaagcagccggccagcaagcatgtcggcacgacgatcaaattcaaaagcgccgatgccgaagcgctgctattggaaaaaccgacggcaataaaggcgaccccgatcgcgcttaatgcaaacagcatcatcaggacgaacagctgccacagcgggaatgacggatgaatatgaaaagcggcgcccataaagagaacggcgaatagaatttggacggccatgataatgatattcaccgccgcgttcgccaatacatactgctttgatgtgatcggcgttgacagaagcctgtagtatgtcctgttttctctctctttaatcattagttccgtcaggttgcctgcggaatagagcataatgataatgagatacccgatgactgagtaagtcatttctttatggttcgatgtatcttgtaaaacagcggactccgtttgaatgggagaatgcttgaaatcggcgtacatctcctgaaaggcctttgcgtctccgccggaggatttgccgattgaggcgacgctgttcatataattgtacaaataagagctgacatatccggtgacctgggcgcctttcagcgaggtcatgccgatgtgagacggtttcccgtcttttacgctttgggagaagcctttttcaaacgtaatgagcgcctccatttttcctgaagcgatctttgatgaggcggacgcagccgtttcctccgaaatcttcacatgatccagtccttttaaaaacgtgaccgtatcctgtgccacttctccgccgtcttgattgagaatgccgatattgagcgtttcggccccgccgttggcattggtcatgaaggagaggaagacgccgatcagcggagccccgatataaagaatgagctgttttttgctttttgtaatccctttgagagtgtgcgcaaacagccaccagaagtttttcatattacagtccctcccgtctttgaaacgtaaatgcggcgatcagcaaaaagagtgccgctaatgctgtatttaaaccgagtgcaggccatgccgctgatacatcatttgcgtaaatgatgttgttaatcgccttattgatccaggataagggcgacagggcggaaattcctccgccttcatatttgtaataggcgccgccgataatggacatcacctgaacgatgatgacggtgattaatctggcgctttcgggttttctggtcaaatagctcaggctgagcccgaagctgacggccaaaagaatttcagaaacgagaatcaaaagcacaagtcccatgtggctgccccaattcgctttcaagataaatttgctgaaggcgacaacggcaagaatcgtcagaacattcacagccaaaatgccgagcatctttccgagaaagatatcgcttttccggagcggggcggcgatcaggcgatctgcggtgtgccgtattctttccccgcggaataaggtgcttgcaaaaatcgaggcgtacagcccgatcatcgtcgtcatggatatcgcgtaaaaatctttcgctttcggttctttcgctttgtgtaaagacgtctgcttcatataatcgcttttgatttgtccggcggaaggcgccttatgcgccttgtaagcggcggcgcctgctttgtattgattggtaaaagcggtcagcatgccttggacaatcgtgccgtttatgccgctccggtcatttgtatagacttgaaaaccggtgttttttacagtgacgaaagcatccgcctgattttctcgaacctcgtttttgccttttgcctccgtgtccgctttttgaaaatagacatgctctttttttgcggctttcataaactcagtaaaatcatgagaaagagggccgtttgactggtccgtatatacgaccttgatatttccgaccgtcacctctgaatcaaaggcgtttgataatgccgcagtaaaaatcagcatgaagacgatcggaaaagcaagcatgaaaataaaagtccgtctgtcgcgaaaactgattttgatttctttcacggcgatgtgcagaatattcatttgcaatcctcctttcagtgaggtcagtcgcgcaggcttctgcctgtcagcgtgagaaataccgtttctaagtcaggggcctgttcctgtaaggagcggatttcaattcctttgtccatgaagtaccggatcaggcggtttaaattgttgacccctgtgtcagagctgattttcacgctgttttcttccagtgtggcggctctgacgccgggcagctcctgaatatcgccgaggctgatgccgtttccggatgacagctcaatcacgacgtccttcgtgtcggtaatgatggaggtcagctgttcttttgtgccttctgcgatgacttttccgtggtcgatgatggcgatgcgcgtgcatatttcttccacttcctccatgtagtggctcgtgtagatgatcgtgcagcccatttcattcagctttttcactgattgcagaatataatttcttgattgcgggtcaataccgactgtcggttcatccatgatgatcagtttcggccggtgggcaagggcgcaggcgatattgagcctgcgcttcattccgccggaaaaatgcttcggcaaatatttgtgtttatcgctcaagccgacgaatgtcagggcctcctcaacccgttctttcagagccgcccctctcaggccgtacagcccggcgaagaacttcacattttcataggcgtttaattcttcgtaaatcgcgaggtcctgagggacgatgccgatattcattttcgttgctttgctatatttgaaaatatcttttccgagaaacagaatgtctccgcctgaaggttttaaaaggcctgagatcatattgatcgtcgtgctttttccggctccgtttgcgccgagaaacccgaaaatctcaccttcttttacggcaagcgacatctggtcaacggcggcataatcaccgaatttcttactcagctgtttgagctccaaaatgttcatgtttccacctctatgtcttatgatgctcttattataaaaaaaagaatgaacggccgttagtgcagctgttcattcctttgacatgagaatcttcatatttttcacatgaaaacattcacttattcaaccggaagcaatgtcgtgacggaaaaaccggccgtgccgtcaaaaataacggttccgtgcaaaacggccgcccgttcttccataccgagcatgccgagtccttttttaaagcggacggcgccgtttccgttatctttcacttccgctttcacggctttgttcagcacatggatatcaatgaagatctgtgtggcatcggcgtatttcattgcattggtcaaggcttcggttacgttttcctgaatgactctccaatgcatttgcgtcagtctgtccaaatcgccttgatgcgtaaacggaaccggcatcccgtttttggccgaaaattcatcaataaacgttcttaatctgtgaatgcccatttgttcagcgggcggtttcatatttttaagcgtaatgcggatatcctctatgccttctttggaaatggtaatggcgttttggagcagttcagccgctttgtccggatgggagccgagcatccgcttcgccgcttccatctgaatgagcgcgcctgtcatggaatggccgattttgtcatggatggcttgggacaacctgtttctttcttcgagtttgccggtatactccgattgtttgatatattctgtgctgctgtgcagctgtttcgtcagtttttcaatgcttgagcgcatattgtctgactgctcttcatattttttcagccggtcgctggaccgggcggccaaaacgaatatcgccaagcagaacaaggtcatgacgatataagtcggaaggtcgccgtacgggataaataaaaacggcaaaaacacgagcaggcagaacacatagcggtgaaccggatattcggcaagaacggcaaaaatggcgggcggcaaaagaaatagaaacgccggatggcctaaggcggaaagccaggcagtcaatgcaagcgaaagcagggtgatcccgcgcctccaagcgggcggcctgatcatgcagaccgcaatgcccaaagacagataagcgagcagaaacaagacggcgtacggcgtgtaagggcggtctgccgatacgaacaaaaaagccgtataaaaaatggcgatcagtctgctcatcagcatccaaaaatccataccgttcaacgcccgttatccaccttcccggtgatataataaatcgcgatctgcgttctgtgctcaagccccgttttccctaaaatagatgaaatataattggccgtcgtcccttcagaaatgaaaagctgttttgaaatttccctgttcgacagtcctttcgcaataagcgacatgatgctgagctctctttcagtaaactggctttcatcaatctgatgcgcggcttccgccggccggaaaaggctgtcttttattttatccagcacggtgtcctgaagaatgctgtgcccgttgaaaacgcttttgatcgcatcgcgtatccgttccggttcggtattttttaataaatatcctttcgcgccgtttttaatcgcttctaaaatatactcatcgtcgtcaaatgtcgtcaggatcatcggcttcgtatccgtttcctccgcgatccgttttgcggcttcgacaccgttcatcaccggcatgcggacgtccagcaaggcgatatcgacgggattgtgtttacaatactctgccgcctcgagtccgttttccaacgttgccgatacagtaaattcctcatatgtatgcaaaatgattttcattccttctctgatgaaagaattatcatccgcgataatgacattaatcttcatggccgcaccctttgtgtgttttttgtttcattatataccatccgattttaaatcaaaaagccttccggcgaaaggtgcgcggaaggcggatcggtcaagcgggttttttcaattgaatgaaaaacagcatcaggaaagaaatgatcacaatacagatcacccacacccaggcgagtgtttcattgccggagtccatcgcgacgtaaatcgctgtcggcagcgtttgggtgacgccgggaatatttcccgcaaacattaaagtcgccccgaattcacctagcgcccttgcaatactgagaatgcttccggtcaagagggagggaaaggcaagcgggacggaaatacgggtgaacacctgccatctgccggctccgtctactttcgccgctccctcggtgtcagcatcaaccgcggcgaagcccgttttagcggactgatacataagcgggaaggcgacaatggccgaagcgatcaccgcggccgaccacgtgaaaatgacgggctggtgaaaaatccgctcaatcgcccggccgataaagctgtgtttcccgaaaataataatgagaatgaagccgacaacggtaggcggaagaacgagcgggagcataaacagggtctccacagccgtttttccgggaaatcgcgctttcgccatccaggcgccggcaagcgtcccgagaatgatgacggcgatgcctgatgccaaagccacctgaaacgacagtacgacgggagtgaaaaactccgaagccgtaatgttacttggcagtaaatccatatttcttaaacactttcatcgctttatctgactgcagatactgataaaacgcttctgcttctttacggtgctttgtatccttgacgatgccgagcggataaacgatctgatcgtgcgttttcgccggcgcttcatcggtgattttcacctttttcgaaatcagcgcgtctgttttatagacaagcccggcatcgacatttccggtttcaacataagaaagcacctggcgaacgtcttttgcatagacgactttatcttttaccttgtcccacagggataatgccgtcaatgactgtttggcgtattgtccggccggaacggattcaggcgtgccgagcgcgattttttccgcgctgtcttttttcaggtcattcagatgtgtcaggtgtgcgctgtttttctcaggtacgatcatgacgagatcatttttcaaaagatccgtgctgtcctttttgtcgatatctccgtcatgaacgagcttttcgaatttatcttcggctgccgagaagaataaatcagctcccgcgccttgtgaaatttgtttttgcaatgtgcctgatgatccgaagttgtcttgaatggttacgtttgaatgtgatttttcgtagttggtctggatttcttcaagtgcatcctgagcgctggctgccgcagaaacggtcagcgtgactttttcgttttgtccgcccttggacgattgtccggatgagcagcccgcagttgccaggaaaacggccatagccgcagttgtgagtagtgtcgctttctttttcaacattgtgcaccccttatagctaaatatcattagatcaaactaattataacgcaattgtacgtgatggtgcggttttttttcaatatctgaacagttataataaaaacggagcgtgataatatgacagaagccacttcctatacaatagaagaagttgcgggccttttgaaggtctccaaactgacagtatatgatttgataaaaaaaggactcattccggcgtacagggtcggaagacagatgagggtcgatgaagaggacttaaaacaatataaagcaaacatgagaatgtcaaaaaagccatccgtatcagaagctgctgacccgtcccgcgggcgggagccggaaaaaaggcagtccgttatcatcagcgggcaggatgtgtcgatggacctcctcagcaaacagctggaacaaactatacaggcggctccgctccgcaagtacagcggcagtttgaacagcctgatcgagatgtaccgcggagcttgtgacatcgtcagtctgcatttgtacgatggggagacggggcagtataacatcccgtatgtgaagcgcattctttcaggggagccgtttgcgctttttcatgtcgtgctgcggcaagccggattatatgtgaaaaagggcaatccgctgaacattcagggttttcaggacatgagccgaaaagatgtccgcatcgtcaatcgcgaaaaaggatcaggcgcgagggtgctgctggatgaacagctcagatcttccggcattacgccgtctgatgtcgccggctatcatgacattgtcacggatcatctgtcagcggcttcacaagtatcaagcggaaaggcggatatcggagtcgggtcgcagcatgcggcgcatatggcgggcacggactttatcccggtgatcagtgagcagtacgatgtggtcgtcttaaaacaaaaccgggagcttgttcaaagcgtgcaggacattcttaattctgaggaattcaagtctcagctttctcaattatccggatatgatacgaaaatgaccggacggcttatatatgaaacatgaaaaatccctccatataacggagggatttttttattgcttataaaaccgcagcaggtcgccgtttaatattttatcggaaagcatcagctcttgttccgctttttctttctcatcgctgcacgcgctcatgtcagaaagcggttcacccgttttacggctgtaacacgtatttttcgtataaatatgatcatccgtgataaagctgccgtttctcagcaccgcaaacggggtccgctctctggaaaacagatcattgccgaactgaatgctgcctttcgtttcaatgccgagcaggtgaagcagcgtcggtcttacatcaacctgtcccgcggccgaagcaatcgtttccggcgcacggtcggtcaccccgggaatatgaatgataaacggcacgcgctgaagctgaaccgtatcaaacggagtgatttcctctttccctaagaattcggcaagtccttgattatgggcttcggatataccgtaatgatctcccatcaggacgatcatcgcgttgtcatacagtccttcttttttcagcttcttgaaaaagtgtttcagggcctcatcttcatagcggaccgtcgtcacatagcggtttaataactcgctgcttgtgtccggttcttcaatgagctgatcctgtttatcaatttcaaaaggaaaatggttggtcaaagtcagcaggctcgcgtaaaacggctgcggaagcttctttaatttttccgctgactgttcgagaaattccttatccttcaggccccagcctgttgaattttcctgtgtcaccttaaattcatccgcgtcgaaaaaacggtcgattccgaatgccccgtacatctcatcccggttccaaaaggccttatgattggcatgcagaacggctgaatagtattgacggtcttttaacatatggtacatcgtattgaaccggtggccgctttttgtgaaaaaaacggcgccgcttgaagacggatacagcgaattcgcagtaatgaattctgaatctgaggtttttccctgttcagtctgctgataaaaatgagtgaagtcataactttttttccgcagtttatttaaaaacggggtaatctcccgcccgttgacccgctcatccattacaaaacgctgtgttgattcgagcgtaacaaaaatcacattgcgcccctttgcgagcccgaactttgattcggacggcctgctgtagtcggcttgagtgtaattcgcgaccgccgcaaggctgtcttcgtcggcaaacgctttagcccctgcattcagcgtctgcgaaatggtgtcatacaaatgaaagtggaacaggccgattccttttacgagcgcttcacgatcaaaagggtgcttgaacagcttcggctgctcagcctcagacagcgcaaggttgcacagcatgaggccggctgatgcccacgcatacgctttaacggtacgggtgctggctttacctttatcggctttatgccttttaccaagataaaacaaaaccgcaatatccaaaaataaagcgatataaagcgggtgaaacagctcttggacgctgcttcccatatcacccatattgctcgcctgaaacaaaaccggtatggtgataaaatcaatataaaacccgtaaaacaccgtattcgcgattaaaattcccgtcagcatcacatttgccgaaagcagaaagatccgctgttttttttctgtcagcagcagggcgatgccgaacagcggcacaatgaagctcagcggattaatgagaagcagacattcctcaagaaccgaattgttctgcagatcaaaaccgagcttataaacggcataggttttcatccacatgaacaggatggacaggcataaaaaccgatgattgctgaaaaaggttttcttcatatgtatgactcctcaccctaaaagcgaaagatgctttttgtttaagagatgcggccgtgaaccagttcgtataaataatagcaggatacaatcgttaagccggccagcacaagctgctccgaaaagctccccgttctcatataaaggggaagacggaagcggatggcggacggaaacagcagtttaatgccgttgacggtccatgcgtcaagcacaagatgactcgccattccgatcatcagtccggcggaaatgctcggattcggaatataggttgccgtaatgaaaaacataataagcataaacagcaggctgtgtgtaaacgttctgtggccgaacaccgtgcttacgattttggacagaacgggcagcgtcctgccgattttgcttttcgtatggcatatgtcgggaatcagcgccccgagggcacccgctgaggtcataaggaccggatcatacccgtaataatacgcaattgcggaacaagaagcgatgcctcccatgatgtgtgtttttcctgtcatttttcgcttctcctttttatttttgccaaaatcccctgaattacaaatatatcaagagaatgcatgtttgatcaacaaactttacctgttccgccaaaaggaaggagacgcggattccgcatattctgccgcggaaaaagacacattataggtgtaccatatttgataaagaggtgatacagatggctttctttaacaaagaaaaaggaaaaaacagcgataaaaacaaaaatgtcattcaaggcgcgcttgaagacgccggtgcagctctgaaagacgatccgcttcaagaagctgttcaaaagaaaaaaaacaaccgctgaccatataagacgggtagggcgaacgctctatccgttttccatctaatttttccctttgacagatctttttatctctgataacctctgagtagaattgaatgataaaaatcctcactctttctcggtgaggtagaggttgcgcttgatgatgagtcgcacatgccaggctgataggggccgcaaaacatgtgttaaaggcatcagcgccgaagtgtaaagaaagccgatccttctttatgctgggactgtatctgaataagtgcaggactgccgcgtgctttttcgcggagggctatccggagatcaagggtgtgtgtgtttctttaagcatggacttttgttcaggctttttttgcgtgtaaatatgatctcggggtctggtccgtacgaatgaacaaccaggaggtacaggaatggaacagacgaaaaaatggggtttttggttattaacggcgtttgtcgtaggaaatatggtaggctcgggcatcttttcgcttccgagtacgctcgcaaaaatcgcgagcccgttcggcgccacatcggcatggcttttaacgggagccggtgtgttaatgatcgcgctggtcttcggccacttatccatccgcaagcctgagctgacggcggggccgcaaagctatgcgcgtgcgctgttcagcgatcggaaaaaagggaatgcagcgggcttcacgatggtctggggctactgggtggcgagctggatcagcaacgtggcgatcatcacgagccttgccggatatttaacatcatttttcccgattttaacggataagcgtgaaatgttttcgatcggcggtcaggctgttacgctcggccagctgctgacgtttgccgtatgtacggttttattatggggcactcacacgattctcgtcaccagcattaacggtgcgagtaaattaaattttgtcacgacgttttcaaaagtattaggatttattttctttatcattgcaggtttatttgtgtttcaaacgtcgtttttcgatcatttttattttccggttcaaacaggtcctcacacagttgagggaatcggcggacagatccacaatgcggcgatttcaacattatgggcgttcgtcggaattgaatcggcagtcattttatccgggcgcgcccgttcgcagcgcgatgtgaaacgcgccaccattaccggattattgatcgcgctcagcatctatatcatcgtgacattgattacgatgggcgtgcttccgcatggtaagcttgtcggctcggaaaaaccgtttgttgacgtattgtacgcgatcgtcggcaatgcgggaagcgtcatcatggcgattctggcgattttgtgtctgttcggaacgatgctcggctggattcttctcggctctgaagttccgtatcaagcggcgaaatcaggagactttccggctgcttttgcaaaaacgaataaacagggaagcccggttgtgtcgttaatcgtaacgaacgtgatgtcacagatctttatcttttcagttatttcccggacgatcagtgacgcgtttacgtttttaacgacggcggcgacgctcgcttatctgattccgtatctcgtgtcagcgttttacagcctgaagctcatttttacgggtgaaacgtatgacgagataaagggttcaagagtaagagacggtatcatcgccatccttgcctgcatttattctttttatgtcattattaccggaacggccgatttaacgacctttattctcggtatcgggctgttcttcgtcggtttgctgttatatcctttcgtctcaaagaaatttgcaaacaacagacaatcggtatgacaaaaagacatctcacgtctgtgagatgtcttttttatttgcggcggcgggttacgttttgacggcgtgtatataatgaatggtctcgaatgcggttaaatggtcagtgcgtccgctgaaaaaacggtcaagtgtaaagcgtaataaaaagccgctgtgacagcggcttcggggttacttcgttaagctttttgtgatgtagtcgagctggccttcaagtgagatcgggtctgagaaatagaagccgatcggatcaatgcggtagacatggttttgtttgacggcatcgaggttcttccagattgagctgtcaagcacgcctttgtcgtcaccgccggcctgccatggccccataaagatgtagtctcccgcgaagtcaggcagtttctcgagtgaaatgctggcgtagcccggtccttgattaatggctttttcctgcgtcagttttgtggccttcagcccgagtttgtcataaatgatgcttccgccgcggccgaagtctttaccgaatacatagatgtcttttccgtttgtctgcatgatggagatggtttttgacccgaccgctttttgaacctttgttttagcggcagcggttttcttgtcccattcagccagccatttgtctgctttatcttcagtgcctgtcattttcgcaaactctttgaattgatcaatgttgctgagcttgtcatatttaatggcgatggtcggcgcgattttttccagtttttcaatatcggcgccttgtgtcgtccagacaacgattaaatccggctttaagtcaatgattttttcaacggacgtgccgtcgccgatgtttgtcacaccttttgttttccctttgtaataagggtttttaaatacgttttgcggcgcgccgacaacattgatgccgagctgtttaaagtcgccgtagtagccgtcagccatgacgacgacccgtttcgggtgcttcggaattttaatattgccgttttcggctttatacgtgatggtttcttctttttcagaagaacctttcgagtctgaagaattgccgcatgcggccaaagcggcgatgagcagcatggcaatcagcgctgcgccgattttcttgtatgtatggaacatctgacattccttctttcatgagtattagtgataaagagaatcattatcagtgtgattatatcactgctttcatagagaagcacgctcttttttaagaaaaactttctttttttatatgaaattaggtctattaaaagagaagataaaagtgctatactgaaacaagtcattgataatcattatcattaccattcttgttttgagaaaggaagaacgagtgttgggtctattgaaaaagaaacagacaatgacggctctaggggcatcagggagtgaaatccagtggacggcgcgttcattcagagcggctgtgctgctgtgtgccgggattgcggttttattgatcggcgcggccctgtctgtttccatcggagctgccgatattcatctgcggacggtgtgggatgctctctttcactttcagccgcaaaatacatctcatcaaatcatacgcgatctgaggctgccgagaaccgccgccgccgcgctcgtcggggcttttttagctgtgtccggggcgattatgcaggggctgacgcggaacccgcttgctgagccttccattatgggcgtgacgtcggggtcaggatttgcgatcgcattggcgtttgctttttttccgggcctgtctgcggcgggacttgttttgtggtccttcgcgggagcgggaatcggagcgcttattgtgtttggcatcggcctgttttcaaaaggcggtctgacaccggtgaagctcgcgctggccggtacggcagtcggctatttcttaacggggctttcaagcgcgattgcgatccgttttgatgtcgcccaggatgtgaagttctggtatgccggaggagttgcttccgtgaaatgggaaggcgtgcagctgctgttggcggtcggggttatcggacttttgctggcatttctgattgcgcgctcagtgacggtgctgagcttgggtgaggagctggccaaagggctcgggcagtacacatcgcttgtgaaagtaatcggaatgtttgtcgttgtcctcttgacgggggcttcagtctcagtcgccggagccatttcttttatcggcttggtgattccgcatatcacccgatttttagtcggggtagattacaggtggatcattccctgttcggcggtattcggcgccgttctgttagtcttcagtgatattgccgcaagacttgtcaatgcgccgtttgaaacaccggtcggcgctttaaccgcccttatcggcgttccctttttcttttatttggcgcgcagggaaaggagagggctgtaatgaatgtaaaatcgaaaaaaccgctggcggtcatggccgttacgtttttgctcatatgcatcgtcttttttatcagcttaaacatgggcgtgatccggattgcgcctcttgatacgctacgtgtctttttcggacaaggggatgcccgggatcagctcgttttatttgaattcagactgccgcgcatggtgctgtcattgctggtcggcgccggaatcgcggtttcaggcgcgatttttcaaagcgtgtctcaaaatgacttggcggagccgggcattctcgggattaacgccggggcgtctttggcggtcgttttgtttatcttctttttccaaggatcagctgctgatttaagcatggccggtacatggctgcttccggtgagcgctttggcgggggcttttctggctgcgctgctcatctatgtgctggcttggaaaaaaggcgtttcacctgtccggctcgttttggtcgggatcggcgtcaatgcggggtttaatgcgcttctcttgatttttcagctgaaaatggacccgcgggatttcatgcaggcgcttgtatggatttccggttcgatttggaacgccaattggaaaatggtgctgtccattttgccgtggctgctggttcttttaccgttcagcctctataaagccaggtatttaaatgtgctccagctcggtgatcagctggcggcggggcttggcacccgggttgaaaaggagcggcgcgttctgctgatgtgcgccgttgccctgaccgcgtcatgtgttgcggcagccggcggaatcgcttttctcggactcattgcgccgcatttggccagaaggcttaccggaccgcgccaccagacgcttatcccggtttcggctttaatcggagcatttttatttctgcttgccgatacgctggcgagaaatgtgcttgcaccgtccgaagttcccgtcggcctggtgatttccgtgctcggagcgccgtattttgtatatttgctgatgaaaacgaaatagaggaaggagactgccgcgatgaactcattatcggcggaacagcttactgtcggttatggcgaccgtttgatagcgaaagaattggatatcgccatcccgaaaggaaaaattacaacgctgatcggtccgaacggctgcggaaaatcgacggttctcaaaacgatgtcaagaatcatgaaaccgaaatccggcgccgtctatttaaacggacaggcgatcatgcaaaaatccacgaaagacatcgccaaggaaatggcaattcttccgcagacgcctgaagcgccgagcgggctgacggtgtacgaacttgtttcttacggcaggtttccgcatcagtccggaatgggccgtttgagtgataaagaccgtgacatgatcaaatgggcgcttgaagagacggggatggccgaattttacgaccggccgatcgaagcgctttccggggggcagcggcagcgtgtgtggatcgccatggcgctcgctcaagaaacggagctgctgcttcttgatgaaccgaccacttatttagatctcgcccatcagcttgaaattttgcagctgctggacaaattaaacaaggagcagggccgcaccattttaatggtcattcatgatctgaaccatgccgcccgtttttcccattacatgatcgccctgaaaaaagggcgcgtcatcaaggaaggaacggcggaggaagtcatgactcccggcatattggaagacgttttccaaattgacgcacagattgtaaaagatccgcgcacgaacaaaccggtctgcttaacctacgatttaatccggcatgaaaacgcaacggtatgatgaaaaaaaacgcagagccattccggcctgcgtttttttattgcgcccggggctgcttttgtccggagacgcatttatccaaaacgaaaaaaacccccgccacaatcagctcctccgtcgttgacagccaaatcttttcaatcagtttatccgtcgtatacgcggtcatccagaggaacagcagctgaacggtgctggctaaaaggagaaaaggcagcctgcccgtcccaaaaaaggtaaagctatgtatcatcagccgctcaagcggttcaaaacataaaccgagaaaaataaaaagcacggaaaaaagcaggacgtacgccatcgatccgtagctcgtcccggctaatgaaaatacggccatcatcacgataaaatacccgaataatacggcagcggctgccagggcataccggagcacctgaagaaaaaacattttcgtcccgttttgattgatcatctgttcagctccttttcacacagaggagacttgcagagacggaactctgcaagtcgatgtatcttcagcatttctttttgacgacagggtgtttctctttcgaaagaatatccgtaaagtctttgcccagatccagatgctgctggacgaatttctcaggaagcatggcaagccattggttcagggacacatcggcatagtggtcatccttgaagatttccaggaagacgagcggctcatctcccaaattctccacatagtggcccattgcgaacgggacgtaaccgacatccccggcctgatagttaaatgttctcgcatggccgtccgatgcaaaaaccgtcatccgtcctttaccggaaatataatactgccattcatgcgtgttcggatgccagtgcagctctctcattgcgcccggttcgaccacgacaagcgctgaagcgatcgttttggacactttgaagtttgtggaatccgcgatatatactttgccgccatctgtctcagcagtcgggccttcatccagcaggcggtaagtgaacggataaggcacttcaccgttcgggccttccacgatgtcatctttcagcttcccgggaaccggctcttcaaagatatatttttctttcccgggcaggccggcgaggtctttttctgaaaccccaaagttgttggcgatgacatcaagcggtgtgtgggcaagccagtcagttacttggaatgtgctgttttctgagaaagaaccgtcatcaaaaaccaagaggaattcacagccttctttcagcgcctgaatggagtgcggcaggcctgacgggaagtaccacagatctccttccttcacgtcatcgataaaactgcgtccctgttcatcaacaatcgtgacccgcgctttgcccgtcagcatatatgcccattccgcttctttatgccagtgcagctcacggatggcgcccggttttaaacgcatgttgacagatgccagattttcagaaatcggcagctcgcgaacggtcacctcacgcgcgtatccgcccttttccagccggttgtgcacatctgagaaagagaatttcatattatccactgtgccgtgatccgtttccggcggcgtcagcatatccggattttggcggtctctttcaaggttgcgcggaatcgtgacggtcgctcctttgtctcctctgatcggctgcgggatattgcagttgttttcttttgacatgtaaatcgtctcctctcaagctttgttttttcagaaagagaatgtgaaaggcctttcgttttcccttctgctttgttaagtgatgcgttccgatgaaaagtcaacttcgtgtgaaaattaatttttcattttctgatctttcagttccgtcatcagttcgatcagggcgtcaaacttcttctcaaaccgtgtgagaagatacatggcaatcagagccggaaagccgagattgccgatctgtctgaccgcttcttctataaaaacctgatccattgtcagccacctcctgacttgacctgcagtcatgtatataagtgaaagaaagagcggctcttgtaaacctgatatcccgattgagggtcttttttttgttccggcaaaaccgggacataaggagtgcggaatcttagtcggaaaggagtagtttacttttttttgctttctttcatttaatttaaatagggggcggttttatggactatcaagttcttttacggtcaaaatgcaaggaaattatgaaacatccgatcgttaaacattttttaagtgacccaaagcattacgagaaatttaaaaatgtgctggaacattcagacgagaaggatgcaaaatcactggacgaccattttaaacagttttataaggaaatccggatcatcaaatatatgaactctatgatccggattttctccatcgattttgacaagcgcatccgtaaaaatcagaagcgctatccgctgacggtggatcagccggagggaggtgaagcgcttccctatgaaatgggaaaagacgcgtttgaagagtttctgcggaagcagggggatttgagccagcatgtccaaaaccgtgatttatacgaagcgcttcagacgttaaccgataaacaaaaaagcgtgctgacgaatatttatcttcacggagcgacgatgaaggagattgccgagtcgctgggtgaatcacggcagaacatttccaatattcataaaaaagggctcgacaatctcagaaagcagctggacaagcaaaaaaagggggaaaataagcagtgaacgggccatttgacttcaacaaagagaacacagataccgacgaaatggaacttttgatttcgcgtttttcgccaatgataaaaaaaaaactgagcaatacatcataccaggaaagagaagatcttgaacaagaattgaagattaaaatcgttgaaaaagcggacatgctgttatgccaggaagtgccgggtttttgggaatttattcttcatcttataaatgaaagctcctgacaaaagcggcggaatgatggatattccgctctgacaacgtgagaaaaacgagaagagatgtccggtctcgtttttcttttctgtttccccgcaagacctccgcactaaaaaggtaccaaatcttatccatataatgatatgatgaaaaaaacaaagagaaaggaacgtccaaggtggaaaatgcgtcaattttaattgtagacgatgagaaggcgatcgttgatatggtcaaacgcgttctcgtcaaagaaggctatcacaacattaagacagccggaagcgctgaggaagcgatcgagtttgttaaacatgaaaccgcggatctgctcgtgctggatgtgatgatggaaggcatgtccggttttgaagcatgcaccgaaatccggaactataccgacgctccgatcttttttctgaccgcccgttcttctgatgcggataagctgtcaggatttgcattgggagctgacgattatataacaaagccgtttaatccgctcgaattggcggcgcggatcagagcgacgttaaagagaacctataagcgcgaagagaaaacggcggtaaagacgtattcatacagccatttttcctattcgccgcaaaacgccgagctgatcgtcgggggcgagcccgtcagctgctccgcacagcttctgcagctgcttcaatatttctgtgaacaccctgatgtggtgctctcaaaagatcagatctatgaaaaagtatggggatatccgtcttacggcgacaacaacaccgtcatggtgcatatccgcaagctcagagaaaaaattgaaaaagaccccagcaatccgtcctatattgtaacggtgcgcggcctcggttatcggtttattcccgatcaaggagaaaaaggaacccgctcatgagaatgcgcggaaaatttctgctccactttttcggacagcttctgcttgtcatcctgctgatgtccgttttggccgtcgcttcttttttctatttggattggcgtttcagcgaagcggaagccaatgcgggactgaccaaagcgaccgcggactcgtttgaagcgtggcttgataaaaacgaagacggcacatgggatgtcgatgaatttttaaagatgtcggtccgaaagcagaagggctggcttcagatcattaatgacaatgaaaaaacggactacgcgtacagagtgccgaaagacgtcccgagccattacagcagaaaagatctcttatccatttaccagtaccggaattttgacaactacaagctgaattactggacggtcacgataaatgatgagacctatttgattctgttcggctggaaatccgccagtgagcagcttctcacatacatcgaatcacaggagccatccctcgcttccctttctcaatataaaaagagcacgattgattatattaaacgggaaaaaggggcggtctaccttctcgaagacagcggcagactgctcggggatatcaacagcacgaaaaaagaacggaacaccgtcaatgagcttgaattgctgaaatacagttccaagccgtggaattacaaacgggaaatttcttttaaaagactcgataaaacgaaatggatggtcgcgtcggtgccgaaccccgtgtacatccccgatcacgagtttaacaaatcatttttgagaaatgtgatgaaaaccctcttcctcttgatcggaatcttagtatttatgatctgcatcctgaccatctggtactctttccgtttcggctggccgctgtttcataccatcaaatggctcgtcaatttatcaaagggccggcttgaagagccgaagaaccgcaaaggacagccggtcagcaaaaacaaaaaaggcaaaacaaaacagccgttccgctttttcgccgagattttcgaatcgatggatcagctgaccgacacgctgaagcgggataagaaaaacagagaaaaaatccaggcgacaagggaagaatggatcgccgggctgagccatgacttaaaaaccccgctgagcacgatttacggctacagcatgatgcttgaatcgaagcaatacgactggaccccggaagaagtcaaagaaatggggcagatcgtccgggaaaaatcagaatatatgtctaagctgattgaggacttaaacttaacataccgcctcaaaaacgcggccctcccgatcgaacggcggctgatcaacgtcgtgccgtttatcagaaacgtcacgaacgatttcacgaaaaacacgttctcggaaggatatgacatcgcctttgaaaccaaaaaggaagacattcttttcgccattgatgaagcgtggttccgccgtattctggagaatctgctggcaaacgcggttaagcataataagaaagggaccgccattcgggtcgtgcttgaggaatcagccgaacagctcattctgaaggtgaaagataacggaagaggaatggacgatgaaacgattcaccagctgtttaaccgttattatcggggaacgaatacgaagggaccgtcagaaggaacgggactcgggctcgccattgccaaggagctggttcaccttcataacggaaccatccatgtcaacagcagaatcagcgccggaacggtgattacgattctttttaaaaaagattgagtttggacgccgctttgtcgggaataacaatagaagactgacaagcaaaagaggtgttcacacatggaagcagcattacgagcagatacgagagcagttatcggagaaggccctttatgggataaggacaagcaatgcctgtactgggtggatatactgggcagccagctgcatatcttcactccggctgacggaatcaaccgttccgttaaattcaaatcatttgtcacggctctggccttgtattcaaaggaagagctggtgatgacgatgaaagacggtttttacctgtacaatcttcgggaagatacattgacgaagatgaagcagccgaaagacatgcgggaagatatccgtttcaatgacgcaaaatgcgatccgtccggcagattatgggcgggaacgacgagcatggaaggcaaagaagaggaggcttcgctgtaccgtctgaatacggacggcagccttgccaaaataaaagaccaggtctccacctcgaacggtttggattgggatcgggaccgaaacctgatgtactatatcgatactccgacgcaggaaatcgtctgttattcatatgatcctgaaaccggagccgtatcagatccgaaaacggtctaccgctttccgaagtcgcaaggatctcccgacggaatgaccattgaccgtgacggaatgctgtgggtggctctgttcggaggcggccgtgccgtccggattgacccgtttttgcataaggaaattgcatctatcgaagttccggcgaaatacgtcacctgctgcgcgttcggaggcagagacttgaacacgttatacattacgaccgcgacggaaaaattgacggaagccgaaagacttgagcagccgcatgcgggcggcctgttttcagcagagcttgagacgggcggctgggagccggttccgtttgcaggcatgatgtaaaaaaaagccctggcatatggggaagttcccattgtgccgggcttttttgtgttaaatggagcggatgatgccgccttcaacccgctgtgcggtgccattaatggcagaagccgctgatgaagcgagaaatacaatcgtattggcgacttcttccggggttgcatagcgctgaatcaatgatgtcggttcattcactttaaaataatcccggacgaagctgtctgtgtcttctccggcagcctttgcggctccttccatgtaagaagcgacgccttcggtccatgtcggtcccggcagcacggagttgaccgtgacatttgtgcctttcgtcatttccgccattccccgggacaagctgattaacgccgttttcgtcattgaatacggaatcatttgcgcaagcggtttgacaccggcttcactggagatgttcagaatccgtccgctgtttctctcgagcatttgcggcagaaaacgccggcacaggcgcacggcgctcataacattcacttcaaaataccgagtccattcgtcatcagacacctcagcgaagtcttttacttcaaaaaaaccgagattattgacgagaatatcgacttccccgattacacctgcgcgctttatcaagtcatccgcctcatcctgacgcgataaatccgcagcgatgccgtggaccgttccgtaagcggaaagctcctcaaccgtccgttccacagtttctttttttcttccgtttataatcacctcggcgccttcggctaaaaagctttttgccgcggcttttccgatgcctgaggttgatcctgtaatcaaaacgagctttcgttcaagctgtaattccatgataatcctcctttttacaccattgtgtaacagtatacatgatgaattttagtgtgtacgaacaatttgctttcatgcaaaaaggccggatatacaagccttaaagacttatagtataattactgcgaaaaaaggatacgaatgtcaaagagacaatcgtttaccataatcagggggagttaaaagaatgaagaagatcactgccgtctgggcggcgcttttggtcaccgcctttgtgatcgccggctgttccggcgcacaggaagaaggaagcgcggccaaacaaaaagccgtctcaaccgaagcattcccggtaaccattaaggatgccgcgaacgaaaaagtaaccataaagcaggcaccggaaaaaatcgtttccctcatgccgagcaatacggaaattacatacgcgctcggactgggagataaggtcgcaggcgtcacgacaaatgatacatatccgaaagaagcggtaaaaaaaccgaaagtcggagatatgaatgtgaacgctgaaaaagtcatcgcgctgaagccggatctcgtgcttgcccacgcgtcctctatgtccgcttccgccgatgcgatgaagcagctgaaagatgcgggcatcaccgtcttaacggtcaatgatgcgcaatcgttccaagatgtgtacaaatcaatcagcatgatcggaaaagcggccggcaaagaaaagcaggcggataagctgatcaaatcgatgaaatccgacctttccggcatagaaaagaaagcggcggccatttctgaaaaagacgaaaagaaagtattcgtcgaagtgtctcctgacggctacacgacggggaaaggcacgtttatgaacgaaatgcttgaagatatacacgcgaaaaacgccgccggcagccagaccggctgggttcagctgacggatgaagcgattgtcaaaatgaatccggacgtcatcattacgacagacggcgtaaaggccgctgaagtggaaaaacgcgccggctggggtgccgtcaatgcggtcaaacaccacaatgtctattctgttgatcccgaccttgtcacacgctcaggcccgcgccttgtcaaaggggtcgagaagcttgcagaaagcgtttatcctgaaacgtttaaaaagtaaccgcccgctggcctacacggtcagcctgctgtttttagccgtttgtacggcactcggcatttcaatcggcagtctgcatattcctttatccgacgttttttggatcgggatcggccggacatcctcggctgaccctatgaatgtaaatattatgatgaatatccgcctgccgagagtcgttctggctgcccttgtcggagccgcgttatccattgcgggagcggcgtttcagggacttctgaaaaatccgctcgccgacccttatacactcggggtatcttcgggagcctcagcgggagccgttatcaccttgtttttcggcattcagattcccgtcctcggccggttcacactaccggttgtcagcatcgccgcagccattgcggtcatggcggcggttctgtttttcagccgcctcgttcatgcgtcgatgtcggtttcgacgctcattttgacaggcatcatcatgaattcttttctcggggctctcatatcgcttgtgatcgctttaacgggcaatgatctgctcccgattgtccgctggctgttaggaagcgtgtcaatgaggggctggggctatgtcgcgctgtttctgcctttttttctggccgggacggcgcttctgcttatcaatggcagagaattaaacattatgacttatggagaagaaaaggcaaggctgttaggcgtcagtacgggaaaaagaaaatggctgatgatcgccgccggatctctgctgacgggaggagcggttgccgtctcggggacgatcggatttgtcggccttgtcattccccacgtgacacggcttttgtgggggacggatcatcgccatttactgccgctgtcagcattgacgggcgccgggtttctcattttggcggatttgttttcccgcaccgtcattgagcctgtcgaattgccgatcggcattatgacggctttggcgggagcgcctgtgtttgccttgattctgcttcgccagcatcatggagggaaacgcttatgatcagggtgagcagcctgtccggcgggtacggaggccggatgattgtagaagatgtcagctttaccgccggaaaaggtgaatttgtcggcatactcggtccgaacggctcgggaaaaacaacgctgatgaaattgctgacgggaatgctctctccgtcaaaaggcgaggtgctcgtagcaggcaggcccgtcggcggatacaagccgcgggaacttgcgaaaatcatggccgttttgccgcagcatacggagcaagcttttacatttaccgttaaggaaacagtgtccttcggcagatatccgtatcaaaaaggactcttcagacagatggatcaacatgacgaagacattgtccgggaagcgatggaaatgacgggcatcgaccgatatgcgcagcaatccgtccgcaatctgagcggcggggagcggcagcgcgtctttctggcgcaggcgctggctcagcagcctgaggtgctgtgtctggatgagccgacgacctttcttgatctcaaatatcagaaagacctgcttgatacggtgaagcggttgacgagagaaagaggcctgacggtcatcagtatttttcacgacctaaacgccgcaggccaatattgtgatcagctcctgatgatgaaagacggacgcgcttttccgaagcagacgccggatcaggctttgaaaaaagagacgattgaagacatttacggcatcaccgtcagcgctgttgcccagcaatcgtcaccgaaaccgctgatcgctttcatgccggaagcgcaggaggaaagagagcctgtcaacgttccgttcgcctctctgataaacaaaagcggaaataccgtaacgcttcatacagaacggccgttcagaatgttgtcaaccgcatctgacggcccgggcttttcgtggagccgccggctttccggctcagcggccgctggtttgatctgccgtacgtttgattcggtcacaattgccgtgactgcgcagcataccgtttgggtgctgatcagcggacgtttatcggaacagggatttgtacggctgttaacggcagcggctgaagcgagaatgcaggctctttccggcagacaggcaaaaggcgacattgtcatttgcgccttgcagacaggagaggcgatggatgtccctcacgcggaaagagccgtcagaagaggaaccgcggcatgtgtaaaagcggcggaagaaggaggaatacaacgatgaagctgtatacgaaaaccggtgataaaggacagacaagcctgatcggcggcagaacggataaagacagtctgcgggttgaaagctacgggacgattgatgagctgaacagctttatcgggcttgcgcttgcggagcttgatgattgtgagaattgcggtgatgtgaaagccgaactccgaaacattcagcatgagctgtttgactgcggcggcgacttggcgacggtcactgaacatagaagctatacattaagagagacatctatttccgcattggaagactgcatagaccgttacacggctgaagcgcccccgcttgagaaatttattcttccgggcgggcataaggcggctgctcagcttcacatcgcgcggaccgtcacgagacgggctgagcgtctcatcgtgaaactcggcaaaacagaagagataaacgatacggtgatgcgttacttgaaccgcctgtctgattattttttcgcggcggcaagagcggttaacgcaagacagggcgttcaggatatagaatatgaaagaagcgccgcggtattccgtgatgatgaataatgttttgttcagccggcatcagcaagccggctgtttttttatagagatatccatcaattgaacctttattgacaggaggaaaatgtatcttatgcattattgactgaaaaattaaaaaatgagatattataagaaacattgtaaaataatgggggatttgatagatggatacatataataagagcgagagcatctggaataaaaatttcacccttctgtttatctcaaggctagttaaattgtcaggcgacggttttgcctttaattccattctgtggtttttgatttttgacggggaaggcgcgatcggcacgtccctgctcattgcggtcacgttccttccggaggcgatgctggcgccgattaccgggccttttatgaagcagcatacgctgaaattctggatgtatttctccgacctgacgcgcgcggcggtcgtgttgatcattccggtctgttactttaacggtttttctcctttatggtttgtcatgcttcttatgattgtgcattcagccacgggagccgcttataatcctgcatctatctcattaatccccaatattgtcagagaaaacagcctgcagaaagcgaatgcggtcatccagtcatcaggccagatcgtcaggcttgccgccattacgctgagcggggtgttcttaacatttatcagtcccgcttattctttgtttatcgctctcatattctatcttctatcaggttttctcgtactctttatgtcataccaagtccagcatgccaaacaggatacagtcgccgtcagacagcgcgggacgtatttcggaaggctcaaacggggtttcgttcttgtcaggaaacaccagattttatacccgctcgccatctattgtatcttcatgaattttgcggccgctccgtgggaggcgctctctgccgtttatgtcgccgaagatttaaacatgccgccgattatctactcgcttttgaaagcgacaggcacgggcggagcctttttaatgggttttattttggctaaggtgaaggtgaacaaatacggtctcctgtttgtgtcagcgggaatcatagaaggagcggcatttttcatcaccggcctcaacacttttctgccgctcgtcttcctcgccgcgtttgcgttcggatctgccgtcagcgcgattaatgtgccggaatatacgattattcagacgtctgtggaccatgatgaccagccgcaagtctatgccgtcatccatatgatctcaaacatatccattccgctcggcgcggttctttgcggatacgcggctaacgccttcggtcccggaaaagtcattgccgccggcggtctcgttgaagtcctgtccggtctcggaatattgttctttacgaagctggccaaagccgaacgctcagatctcatcagggaaaaagaagcgagcatcagaatatagatttttcgtgaaacgccctgcgccgtccggtgcagcggcgtttttttatgcgaaggtccgggggcttatacgactccggtctgatatgaaaatcaatctctgactcgttttgccggccgcgggatttgtttatagtaaagacaaggaaaacgaaaggaggatctgcatgaatataaatggcaaaacggcaggcggctttctgctgattgtgttcggactttctgtctttttcggaggaggccatttcgcatttatcatcccgctggcgatcggaggcctgatgctttactggggaatcaaacgtttttcaaaaggccgggcggtatcgggtatcatcgcgggcgtcatcggagctatgattctcgtcggttctcttccatttatcgttgcgatcggactggccggcgccatggtgtatttcgggtggaagatgatgaagcagggcggctcagataccgcttcccgccagtatgaaccggaagcggcatcaccgggctatcaatccggatttgactctgaatgggaagaatttctgaagaaaaaataaggaggaagacaaaatggtcttaaaaagaataagaaatatgttcgtcgcatctgttaacgaagggcttgataaattagaaaatccgaaagtcatgctgaatcaatatgtgcgtgatatggaaagtgacatcgctaaggcgaaacaaacgattgtcaaacagcatacgatcgtccatcagtttaagaaaaaacaggaagacgcctccgaaacggcggcaaaacggaaaaaccaggctcagcttgcttttgatgccggggaagaggagctggcgaaaaaggcgctgactgaaatgaaataccttgagggaaaagcggccgaacatgaaaaagcgtatgagcaggcgaaaacacagctggcagagctgaaagagcagctggaaactttagaaacgcgcctccgcgacgtaaaggataaaaaacaggcgctcatcgcccgcgcaaacgcggcaaatgcgaaggaacatatgaacgcttctttcgacaaaattgacagcgaaagcgcctacagagagttccttcgaatggaaagccgcattgaagaaatggaagtccgcgtcaaatacggcacttcagctgaggcgaacacagaatacagccgctcccaatattcagacgaggtggaagctgagattgaaaaaatgcgctcgctttctctggaaaaaacagagcgtcaaaaagcggctcatgaataatgtgcacaagggaagatcggcgcgtttacgcctcttccctatacgcacgtatcaattatccggcttttcctttataataaaatgaatgaaaaaggatggaacgtaatgaagcgtaagattgccaaaggactgatggcggcgtccgttctgatctgctgtctgtttttggtgaaagaagtgtttgccgggcgtttttttccgttgtgcgaaacagaagcggaatcggcaagcataccgccgcgtgccgtcaacagcctgtcggtttcatcggaacagacggatgtaaaaatcatcgcggaagcgcggaatgatatcgcggcaaacatgacgggatcggcggggaaaatgtttgtccaaaacaggggaaagaccctcaatctcaaagcgaaggagaaagggttccaatttctgaatctctttcagcgccctctgctgattgtccgcattccgtatgattatcatcgggatatcaccgtccatacatcaagcggcagcattgccgtcgacggaaacaaggggctgtctcttgcgcacctcggcgtccgttctgtaagcgggaacatgtcgctgaagcacgtgaagacggatgtgtttgaagcgaaggggctgtcgggcaatctcacagcagcaggccttgcggcaaaaacgggggctgtccgtttatcctcgggacatgtcgggcttcaacatgtggcgggcgcccttgacgtgcgggtcgcttctggcagtgtcgatgcctcgcttgagacggcggatgctcccgtatccgtcaggcttgcgagcggcagcgcagcgatcagcctgccgaaagacggaagttttacggtgaacgccgagacggcaagcggaaggattcggccgtcttattcctttgagaaaacgagtaaggaaggcggggcatttaccggcatgaaaggcagcggcgccaggccgattgatataaaagtgacgagcggcaatattgcactgcaatagtcaaggaaaggaggggcaagcagctgatggcaaaaaaacagattctcggacttatcatcgccttattaggtgtcagcatgtttttgcgtattatcggcatcggcgacttcttgttttggccgctcttttttctgatcacaggttatatttttaataaatattcccgcggctggctcggctccgtcctgtatatcttcgccgcttttttatttttgaggaacctgttcagcgccacctttaacctgttcggctatgccttcgccgcctttctcatatacgcgggctacaggctcctgaaaggaaagcgcgtgtatgaacataaagagaagaaaatcaatcttgaaaaagaagagcagccaaagccttccgcccagacggaaagcagacagccggacctccgcagcttttttatcggcgagctccggatgatgaaggacccgtttgagctgaatgatttaaatgtttccggattcatcggcgatgtgaaaattgatttgtcaaaagcgatgattcccgaaggagaaagcacgatgaccatcagcggtgtcatcggcaatgtcgatgtgtacgtcccgccggatatcgaagtgtccgtcagttcatcggcttttatcggcgatatgaacctgctcggctctaagaaaagcggcatgagcccgaatctgtataaagtatcgtctgagtacggcgactcgccgcggcggattaaaatttcaatttcgttattcatcggcgatgtggatgtgaagtatttatgaggaaaaaattactcgccaatattcagtggcgcgccatgcggatgaccgcgggactcagtctgctcctttgcgcggtgtttattacgctgatgctgctgtattacgggcttgacccgatgctgctgttttcttccggctggttcggtattccgtttgtggtcatcctgcttttggcgtctctttcggcggggttgatttccggttatgtatatggcggccgcctgaaaacaagaatggatacactgattgaagcggttttgaaatttgaaaacggcaattttgcttatcgggtgccgccgctcggcgatgatgaaatcggtctggcggcagaccaactcaacgaaatggccaagcgggtcgagctccaggttacatcgctgcaaaagctctccaacgaacgggcggaatggcaggatcaaatgaaaaaatcggtcatcactgaagaacgccagcggctggcgcgcgatctgcacgatgccgtcagccagcagctctttgccatttctatgatgacatccgccgtcttagagcaggtgaaagatgcggatgacaaaatcgtcaaacggattcgcatggttgaacatatggcgggggaagcgcaaaacgagatgagagcgctgctattgcatttgcggcccgtcactttagaaggaaaaggcttaaaagaagggctgattgagctgttaaaagagttcaaagcgaagcagccgctggatattgactgggacatcagcgatacgggtgtgtcaaaaggcgttgaagaccatctgttccgcatcgtgcaggaggcgctttccaacgttttcagacattcaaaggcgaccaaggtcaccgtcaggctcggcgcgaaacatcaaaagctgcagcttaaagtcattgataatggggcgggttttacgatggatcaagtgaaagcatcctcatacggcctgcattccatcaaggaaagagcgagtgaaatcggcggcatagcggaaattatctctgtaaagggaaaaggcacgcagatcgacgtgaaagtcccgatttatcagaaaacaaaaggagagaacgacagtgattcgagtgttactgattgatgatcatgaaatggtcaggatgggtctggccgcatttttagaagcacagccggacattgaagtcgccggtgaagcatcagacgggcagcagggcgtcgatctggccgcaaagcttttgccggatgtgattttaatggacctcgtcatggacggcatggacggtatcgaagcgacaaaacagatctgcgcgacactcaatgacccgaaaatcatcgtgctgacgagctttattgatgacgacaaagtgtatccggtgatcgaagcgggagcgctcagctatttgctgaaaacgtccaaggcggcagaaatagccgaagccatcagagcggctgccaagggcgaaccgaagcttgaatcgaaggtggcgggaaaagtgctgtcaaggctgcgccattcagagaatcagcttccgcatgaaacgctgacaaaaagagaactggaaatcctctgtctcgtcgcggaaggcaagacgaataaagagattggtgaagagctgttcattacgattaaaacggtgaaaacccacattacgaatatattgtcaaagcttgatgtcagtgaccgcacgcaggcagccgtatatgcccaccgcaatcatctcgtgacataagaaaaggagagcggtgccagcacactctcccgaggaacggggtcattgggacattccctttgttccgaaatccctgatggcgactttgactttgtattcaatatccgattcactgaagtgatgatcccagtcagaggatatctttttccatttatcgggataatgaatccggacttgatcgcctaacccggtaatatccactttcaactcatgctgcatgtaatcaatgaatgccatgacatctgaatgaatgctgcgttttaccgcgtttttgatttcatttatataggactccttgaaggaatcttctttcgggttccaatcctcagatagacggccttcaacaaaccgggtaacgataaacttgaattttccgtttttatattgtgtttttacatcatatttgctggaaaatacctcgaaagacaaataataattgtcatgctttgcaaacgtaacgcctccctttaccgtgcctgtgaacaggttcatattctggacttgtaaaggagttagattcgcataccagaatttatttttaataatggtagcgccccagatttccagtctgctgcccactttgcgaacttgaggaagggcaaaggtctcgcccttggcgattctctcggatatttcccccaatgtcacgggctccatcatccggatggtgaccgcattattctccgttaagtcatagatcgtatttgacgcaggctctccctggtcactgattttgaaaatatctttcgttttatccggcaccgtcatcacattgcagcttcttctcgtaccgttgtccctgataaattggttcatcaatgcgtcaagcgggatgtcgtcctttaacagcgcctcggaaaacagcatgatacgcaagtgctgggagaaagcggggtgattttttaatgatgccgttcgtaaggcttgatggacggtttctccggaagtggaagtcacctttgtcgtgtcgctccctgacgacgactgctgggaacttgctttttgcggaaccagaatctgctgcgtcacttccacgttttcttcctcgggtttatcgagcccgacgccgataacgagactcaaatcttctatattgcggctgtcccagcatccggccaaaagcaatgtgcaaagaatgattacgatatatttcttcattgcgcttttttcaccttccttttcacagcgacgactgcaaacatcagtaaaggcagcaaaaagaaaaccaagaagatatagccgagaatatcactgaacagcatcagcttgttagcgtcttttggcatcaatgatccgaagaatgtcgcaatgcctacgaaaatgatgccctttttgtgcttcagcccgaaaattttattaagacccgatgtcgcgaaatatccgtacgatacataggtggcgaaaaattggataatccagacggcaagcaaaaaagactcgaatctttcgataaaaagccctttgatttcaaatgattgaaaaagcgcaatcgtaggccagatcattgttttgacatcctgggtggttaaggcgccgacgacgagcacgtaggtaatgatgtataaaataatcgggatgccaaagcccatggccgacatacggaacgtgtgctttttatttttgatgtgctcagggagaaacagcataatctcaattcctaagaatgaaacagaaacgacggtcaaggaagccataacgggagaaaacccctgtccgagcaccggccgcaggttgtccagatcaaatattttaaagctgaaagaaaacaccaccagcaaaataatgatcgtaatcgttaaatagaaaggaaagagcctgccgagatcgctcatgccgccgataattaaataaacggaacaggcgataaagataaacagcgtaaccggcacgggcgttctctccaataaaaagaacttgaccatttccgccatcgcccgggcttcgaagctggcgactcctataaaatagagacagatcataagattgacgatatttcccgcccatttgccgaggccttcgttcatataatcaaacaatgatccgtactgatgctttttcataatgagcgtattgagataaatcaaaaagataaagatgaagccttccagacataatgcaatccagccgtccggcgaattcgcccttgatgacagcgaccgcggcatggtaaggagtcccgccccgagcatcgtgttggaaatcaatgccgtcccttgatagcttgtaagcttattgagagttgttttctggctcatttacgtttttcgcctcttttggttgatttttaatagggagacggagaatagagtcgtttgcgttttttaagctgaaaaatccattcggcgagaaatacggagaaccgaagcttcgctgtctcgataaatgagtgtagatcgccagcataaataaaatcatgccgtacagcccgaaagctgcggcggtaaacatcgaaatgaaacggagcacacggaatgacagacccatcccgtactgcggcaccgtaaatgaagcaagcgcgacaatgctgaccacgatgaccatgatggagctgacaatattcgcttcaacggccgcctggccgatgacgactccgcccaccaatccgatcgtctggccgagcgggctgggaagcctcaagcccgcttctctcagcagctctatcgtaatttccattaccatcgcttcaatgataggcgggaagggaacgttttctctgttcgccgcgatggtgactgcaagcgatgtcggcagcagcccttggtgaaacgaaacgagggcgatataaatggacgaaaaaaacagcgtaataaaaatagacgtaaaccgcagcacccggatgagcgaggcggaaatccaccgttcataataatcatcgggagactgcattaaaattcctaaagaagccggaaccaccagcgcaaacggcgagttgtcgacaaggatggcgacgcggccgttgaacaaggcggaagagactttatcaggccgttccgtattttgtatttgcggaaagggcgaatacttattatcctcaataagctcctcaagcgttccggaatcctgaatgtcgtccatcttcacttcgctgaggcgctttacaacatcgctgacgacagatgggtccgccttatcatctatgtacatgaccgtggcgtattttaacttattttctccgatcggaacctttttcgttttcagcttcggatggttcgtgcgctgcctgatcatggcgacgtttgtatcagaatcttctatgaaggcgattttcggacctcttacgaccttttcggatgtgggttcattcacgcttcttttttctctttttcccgtggacaaaatgtatacgctgtcaagtccgttaataaataaggcgcattttccccgcagaatggagatgacggcttccttcgacgtaaagacgggacgggcgtcaatcttatcaagacgtttcgacaccgtatccagcgtcagagtgtcttcttcccgaagcagcgtttcaatcgcttcttttattttgtcttcatcgttcatttcactcagatacatataataaaaaacaagcccgttcggaagcatctttttattttgaaccaggtcatcattctgctctacgtggggaagcaccagtgccaggttaacgtgtatgtattccttgaattccgattgcgccaacgacagtcacccgccttccaatccttaattgaggttatcttttcctgttaaaaaaatgatatactatgataaagtatttaatggtacaagtttttttatgaaagcggaggagagatgtggcacaagtcagactggcaggaaatgccgaagaaattgaacagctcatcaaatcatttgaggcgcattacgaagtggcttacacgtcgaaagaataccgtaaaacaaatccgaagtataaatactctaaggattcgcgcgtctatcttgagctgaaattaaaaacggccaaggccgaaaaataaaaagggtttcatctgttactggcgaataatactcagggtgaagcaactgttatggagggatacataaatggactacagaattgaaaaagacaccatgggagaagttaaagttccggcagataaattttggggcgctcagacacagcgcagcaaagagaacttcaaaatcggttcagaaaaaatgcctcagcgtgttgtgaaggcgtttgcaatattgaaaagaagtacagcgatcgccaacgaacgcctcggcaacttagagtctgaaaaagcacaggcgattgccgctgtatgtgacgatgttttaaacggcaaatacgacgataactttccgctcgttgtctggcagacgggaagcggcacgcaaagcaacatgaacatgaatgaagtggtggccaaccgcgcgactgctttattgaaagaaaaaaattccgagctgaagattcatccgaatgatgacgttaaccgcagccaaagctcaaacgatacattcccgacggcgatgcacgttgcggcggttcttgccgtatatgagcagctcgttccggcgcttgatcagctgcgcgcgacgcttgatgaaaaagcgaaagcttatcaggatattgtgaaaatcggacgcacgcatttgcaggacgccactccgctgacgctcggacaggaaatcagcggctgggtatacatgcttgaccgttcgaaagaaatgattcttgagtcaacggaaaaaatccgcgcgcttgccatcggaggcacggcagtcggcacgggaatcaacgcccatccgcagttcggtgaattcgtcgcggaagaaatcacaaaagtaacggggcagacattcaagagttcgcctaacaaattccacgcgctcacaagccatgatgaaatcactcacgttcacggcgcgttaaaagcattggctgccgacctgatgaagattgccaacgatgtcagatggctggcaagcggcccgcgctgcggaatcggcgaaatcgtcattcctgaaaatgagccgggaagctctatcatgccgggcaaagtcaacccgacgcaaagtgaggcgctgacaatgatcgccgcgcaagtgatgggaaatgacgcgacaatcggatttgcggccagccaaggaaacttcgagctgaatgtcttcaaaccggttattatctataacttcctgcagaccgtgcagctgctcagtgacggaatgaattccttccatgacaaatgcgctgtcggtattgagccgaaccaagagacgattcaggaaaatctctctaactcattaatgcttgttacggcgcttaacccgcacatcggttatgaaaacgccgcgaaaatcgccaagcttgcccacaaagaaggcctgacgctgaaagaagcggcattacagctgaaccttctgacagaagaacaatttaatgaaatggtgcgtccggaagatatggtgcacccgaaagcataaaaagaaagaacggctgcagtcattgcggccgttcttctaaataaactgctgtttcagtaaaaatctgagctgttctgcatcttcagccagcaggtcggattccttcaaattcaaaatcattcctttgatgattgccggtttcggcgactttttcttcatttccgcttccagaatatccaagctctcggtgaattcagatgcttgcgtcttatccatcgtgccgatgcgcgtgcggagggtctgcaagatcgattggcttaaaggatcgggctgcccgttatgaaggggcccaaacagtgagcttgcctcatcaagagaaataaacgcttcatcatgtctgtccgccattccgtttacgatgtcatcaattctgtgaatcacggtatttgccaaaagcgaaggctgtacggaccggccggtcagaatgagatattcaagatacatctgactgattccttctattaaaaaacaaagctcggctgtgtatggttcagctttttctccgtaaatcgcaagaagactgtcgatatgaaactgcaggatcgaccggcggattctctttccgcactgcgccgcttcttcggtataaggaagtgaaccgtctttcatctgcacggtaataaaatcctgatgggcgagaatcgattcgtaaaacaccgcaagctgtttttggtaagcggctctcggactgtcaccctccgtttggatcgtcgtgattcgggtaaacgttttatcatagtagtaattcagcatggataggagcagtgcttctttggaaggaaagtaaagataaaaagcgccttttgagattttgcattcatcggcgatttcctgaaccgatgtagatttgtacccttttcgggcaaacagtttgattgctgcttcaatgatcagcttttctttttccttcaatggttccaccctttcggagccaggaggctggcttgtgcttctcatgtatgactatatggtcatattgatattccgtaaatttaacctgattgtaacttgtttttttgttttgttttatttatattataaagtgagctgaccgaatggtcaaagttctggcgaaagggtgaatctgaaaatgaaagaattagatgaaatgatcagccgcttgcgaaacagaggaattaaagtcgaaaaggtgaaatatccgaaaaagacaatttgtgaaaagaaatgggttcatcaatgccaaaaaccgctgaaagcaaactacagagattttaacggctattccttcacataaaaaaagactgcaatggaacactacagtctactttggtatgataattcggtagattacacccgattggtcattttcaattgaaattgatgctttatgcaaggttaaaatccgttttacgatgctgagtcctatgccgaactcgcctttcttccctttattaaaaggctcgtacaagctggatagcatctcatcctcaatcggaggcccgtcattttcaaccgtcatgacaatctgctgctgattttggctgatccgaatgtgaatcgccgtttctgcatagcggatttgattttcgagaatgttttcaagaagtttgctccattgttccggatcaccaggcatcattaatgcatcttctgtatcaacggtccacgataattccttccgggcccatttgagccgttcaatgacttcttccgtgaccttcacaatgtcaaatgtctcatggtgcacccgctgcttcattaaataatcaagcttcgttaaatataataaatccttaattttcttctcaagtttttctgcttcgccttcaatgacatcaattgtggtttccagatcccccttaggaaaaatcccgtcctttattgattgagtatagccccttatcaccatgacaggcgtttttaaatcatgagagatattttgcaggagcgttctttccgtttcgtctttttgcaccagcttgctccgcatgtcttcaatggtatggcctaattttccgatttcgtcttttctgtcgacgatgaccggatcatcccaatcctgttttgaaatccgtttgacatgcttctctaaggaaacgagcgggcgcgagagatatttggcaagccaaatcgccggaatccagcttaacaaaatcacgccggcaatgataaagagcagctgcttgaacagggtgaatgccagatcatcacgataagaatcaagggcgtaagacagcatcatcgcatcctggccgttaatggtgaggccttttttaatgacgaaaaacactttttcaccgctgatgtccgcgctgtatcgtttcgtgacgctgtgctggcggcccgcgagcttgtacaccttatggataaaggaagaagaaaagtagttcaagtctttgtcactggccgactcctcccgttccggcagaagaacgtgctgaacggatcggaaagtcgtcggcgcggtcgcatcctcgctgtaatatccccgctcgatcgatccgggcagccggtactccgtcagtacatgctgttcattttcaatggtcgtatacgtttcatccgtgaaaaaattacgcagcgtatttgagaacagcacgagaagcagaatcgaaatggctaagaggatgcctgagatgaccacccatatttgaaaagcaagcggcttatttttcatgacgtcatcatcctgtagccgaatccgtaaatggtttcaacctttaacccgggcatttttttccgcagcctccgcacaagatcatcgaccacccggtcagtgccgaaataatcatggccccatatattcagcaggatatcttctctggaaaaggggtgtcctttatggtgaagaaataaaagcagcagatcaaattccttagacgtcaaattgaccaggctgccggtttcatcataaacctctcgggcatcttcgatcacattgtaggaagaaacggtgatgccggttttctttgcggcgggctgttctttatacacgagctcgagcagcttctggacccgtataataagttctctcggcaaaaaaggcttggcgatataatcattgcttccaagctctaacccgaggactctgtcaatatcggcatcccgcgcggaaatgaaaataaccggcacatcgggatctttttcttttatttcttttatcaatgtatagccgtccgtatccggaagcatgatgtcaagaatccacaagtggggagacggctgcatctgctttctggcatcttcgccttttgtgaaagatgtaatgttccagccttcattctctaaatattttgtgagcagttcattcaggttatcctcatcttcaactagataaatggtgtatgacaaggcatttcacatcctttcaacgtcattatactagttttaacatactcaagccgcattttcataatttcacatattcttttcatttttatcccacaatgtttgtttatgatgtgtataagggaagaaaggaagaaaaaaagcggggaagataacatgttcaaacacattttgttttggagctttgcttttctccttattattgggacaatagaacttgtacatgcgatgaatatgtaatcgatagaatgaaaacatgctgaaggagtgtgcgtgaatatgaacgatcatcgagatgacggcagaagccgcgatcagtcagatctttcacatacggaacaaaacagaaatgaacagcagcagatcagccatcaggagcccgagctgctcgaaggcccagtctcgaaagaagcggaaaacgagacggcggccggtacggaatttgaaaaaacggctgccgtgaaaaaagaaaaaaaacggagagccgcttggctgagcccgattttaggcggcattatcggcggaggcctcgtgcttggcattgtgccgaatctgccgagtgagcagcataagacagaagccgtttctgatacgaaacaagttcagtcttcgaattttaggtcaacgcctttgaaaaatacctcaagcgtagcggatatggtagaagatttggagcccgcgattgtgggagtgtccaactaccaagcttcgcaaagcagccagttcagacttgacggcggttcaagctctgaaacggaaagcggcacggggtcaggcgtcatcttcaaaaaagacggcgaaaaagcgtacatcattacaaacaaccatgtcgtagaaggtgcgaacaaactgtcggtcactctttacaatgggaaaaccgaaacggcaaagcttgtcggaaaggatgccatcagtgacttggctgtattggaaatcagctcgtccaatgtcaaaaaagcggccagcttcggggattcctccaagctccgcattgccgataaagtgattgccatcggcaacccgctcggccagcagttttccggcaccgtcacacaaggtgtcatcagcgggctgaacagaacggtagacgccgatacatcccaaggcacggtggaaatgaacgtgattcagacggatgcggcgattaaccccggaaacagcggcggcccgttaatcaactcaagcggccaagttatcgggatcaacagcatgaaagtcagtgaaaacggcgtggagtcactcggctttgccattccgagcaatgatgtagaaccgatagtcgaccagctgcttgcaaaaggaaaagtcgagcgcccatttttaggtgtgcagatgattgacatggcgcaagtgccggaaacttatcaggaaaacacgctcggactgttcggcgaccagctgtctaagggtgtttacgtaaaagaagtgcaatccggctcaccggctgcgaaagcgggcatcaaatcaaatgacgtcattgtacaattgaacggcaaagatgtcggcagcagcgccgatatcagacagatcttatataaccagctgaaaatcggcgataaaacgactgttcaagttctcagaaacggaagcaaaaagacgctgaacgtcacattaacgaaacaaaccgaaagcgcaagctgaacgcataaaaaaagctgaaccttcaactgaggttcagcttttttcgtcattctcccaagtaggctgacagcatccacacatgcttgtccgcttcttcaactaatccgacaaacaggtcggcagttgacgggtcattttgttcctcggcgatgccgatgacaaattttgattcgcggctgatttgtttatagtcttgaaccagtgattccaccatttcagaagccgttttttcctggccttcatccgtaatggaagcttgttcaaggtaagtgtgtaaagtcgccgcaggctgtccgccgatggccagaagtcgctctgcgatggcatccgccgtttccgccgcttcgttatatagctcttcaaatttttcatgaagcgtaaagaaatgagggccttttacataccaatggaagcggtgcagtttagagtaaaggataaaccagtttgataattgtgtgttcattgatttctcaacaagagtttcagtttttttcgcgttttgtgtattcatattcatcgtcctccctgtgatctgataatttaattatatcacatattaaataaaaatcaatactaaattataataattataatttaggtttaagtgaacagctttttctttataatcgattcccaggcggaccacggaaagagtgagcggaaagccaatgtcagcttaacgcccctgccgatcggataccgcagtttcttcagccgtttcctttgtgccaattgataaatcagctccgctacgtcatcaggatcgccgcttttggatgcgttggctttgaagtaagcttctatttgctgataatagcggtaataaggcgaatctttgccgggtgccgtaagatgattggagagagacgtttcccatatagatgttttgtaggagcccggttctattaaagcggcatcaattcctaaaggcagcagttcgaggcgcaggctctctgtaaacccttcaaccgcgaatttggaagagacatacggagatagagccgggaaaccggtcagtccgctgatactgctgatattgaagattttcgccccgctatgttttcgcatataaggcagcacggtttttgtgacgtgaatcagaccgaatacatttgattcatactgctgtctgtaatgttccatcagcacatcgtcaataaaccccccgtacgcagtgccggcgttattgacgagcaggtcaatcggtccgaaaccgctgatggtgttcccgaagtcagacaccgactgctcatttgtcacatctaaagaaacgaccgtaacatgttcggatgcacccgcttgagcggcggcctctttcagtatttcagctttctccggctgtctggctgttgcgatgacgtgataagaccgggcgagcttcagcgctgtcagcagcccgaatccgctcgtcgcgccggttacaatggcaatttttctgttcatcttataatcctccccgtttgttcttatctcatagtgtataacatctcgcggaaagaaggagaaatcgttcggaaatatgtcagaattgttttataatggagtcagcttcggatagaaaggggtaaagaaaagatggcattagagggattgaaggaaacatgggatttaaactccatttttgagggcgggagccggtcggaagagtttcagcaatacatacaagagctcaaaaatcatctaagcgcttttcaacatgcggttgaagcgtttacagctccgacgcatgcggatgaaagccgggagctgatcaatctgattgataggtttgaacggtcagcgatcatgatcaggcaggcgggagcgttcgtcggctgtcttcaggctcagaacactcatgatcagaaagcgaatgaatggagggcgcggatcaatcagctgagcagtgattttaaatccgctctggtcacccttgacgatacacttgcccggattgacgagccggtctgggaggagctgctgcaaaaaccggaacttcaggatctcacatatgttttaaatgaaagaagagaccgggtcaaagagaagctcagcgcttcagaagaaaggctgattgaaggcctggccgttgacggctatcacgcatggggcgacctgtataatgcggctgtcggcagaatgaagattccgtttgaggataaagagctgtcggtcggccaagcggaaaatatgatggcgcacccggaccgccgcatcagacatcaagtgttcaaagagcttaatgaagcgtggaaaggagaagaggagcttttcggcagcacgctgaaccatctggccggcttccgcacggaaatctataaagcgcggggctggaaaagcgctttggaagagccgcttgcgatcaaccggatgaaaaaagaaacgctggatgtcatgtggcaggtcattaccgatcataaaaagccttttgccgaatacctgaatcgaaaggcgtctcttttagggcttgagcggctgaactggtatgatgtggacgcgccgatcggcgaggctccgaaagaatatacatatgatgaagcggccaatctgatcgtcagccaattttcgacgtttggcaaaaagctgtccgcatttacggaaaaagcgttccgtgatcggtggatagaagcggaagaccgcagcggcaaacgggtcggcggtttctgcaccagctttcccgacagcggagaatcccggatttttatgacgttttccggaagcgcttcgaatgtatcgacgctggcgcatgagctcggtcacgcgttccatcaggaggccatgcttcaagtgcggcagctgaacagagcctacgctatgaatgtcgctgaaacagcctcgacctttgcggaaatgatcgtcgccgacgccgctttgaaacaagcggagacaaaggatgaaaaggtgttcttgcttgaagataaaattcaaagaagcgtagccatgtttatgaatattcatgcgagatttttatttgaaacgcgtttttatgaagagcgcaagcagggcgtcgttccggctgagaaactgaatgaactgatggaagcggcgcagaaagaagcattttgcgattcattaggggaataccaccctcatttctgggcgtcaaaactgcattttcatattacgggagtgccgttttacaactttccgtatacgttcggttatttattttcgcttggaatatatgcaagagctcttcgggaaaaagcggattttgaagaaaaatatatcgcgcttttgtgtgacacggcttcgatgactgttgaggatttggcgatgaagcaccttggagcggatctgacggaacggtcgttttgggaagacgcggtccgccttgccgtacaggatgtgcaggaatttttagagctgactgaatgataatctggagatgaaccggccggagtgttaccgctccggctcttttttgtttaatgaatgacagccgcctcccttggaaatacctaaaaacgatcggaatggaatgggagtgaatcgcatgaaatggatcagaacggcgggcgttttatgtcttacgctgatgctgattgccggctgccgattgaatgaagaaaaacgggaagcggaacaagacagcacacccgtgtcatccgcgaagccggttccttacagcagctttgcccttcgcgtcagctacggagccggagagcataaccgctatgaaggtttgtatgagagaaaaggcggtcatgaaaaggctgacatccgggacaagctctcaggggttcacagagagggcgaggaagcgcttgatgaaatgaagatgatccttggagaacttgccgtaaacagccggatgaaggaaagtgaggtcgtccggcaggtgctctcggcttttaatttggacagccgctatgaccatttttatctgaaactgaaaaagaatgatggagaaatgacggaaataaaaaaataaccgccgtccgctgcttttttgcccaaaactaattgataatgatattcagagtcattaatttctgttacaatataatcatgatctcacgttgaatgtttaggcaatttgtttatatacatagtgttgggaaactcaaaaaaggagcggttagcggtatgagtgcaatttctacagagacgctgagcttagggtacggagagactgttatcattgacgaattggatgtcgcgattccaaaaggcgaaatcactgtattgatcggaagcaacggctgcggaaaatcgacgcttttacgttcattggcccggctgatgaaaccgaggggcggtactgtgcttttagaaggaaaagccatcgctaagcttccgacgaaggaagtggcaagagagctcgctattttgccgcagagtccgtcagctcccgaaggcctgacggtgcatcagcttgtgaagcagggaagatacccttatcaaagctggctgaagcaatggtccaaagaggacgaagacgcagtggcaaaagcgcttaaagcgacgaagcttgaggaaatggccgaccgtccggtggattccttgtcaggcggacagcgccagcgcgcatggattgcgatgacactcgctcaggatacggatatcattctgcttgacgagccgacaacctatctcgacatgacgcatcaaattgaaattcttgatttgctgtttgaattaaatgaaaaagaaaaacgcacaatcgtcatggtgctgcacgacctcaatctggcatgccgttatgcccattatctggtcgccattaaggataaacagatttacgcagagggccgtcccgaagaagtcatcacttgcgagcttgtacagcaggtctttgcgatgaactgccaggtaacgcaagacccgctgttcggcacgccgctttgcattccgcacggacgcggcagatgtatcgtgcaggaagcggccctcaccgcccgattgtcataatcatgaaaaagggaagggaacggtatggaagagaaactgcagcagcagctggacggcctgcttgagaaatacacggaactattgcttggcgaaacaaacccggatgtaaaggaagaagtcaggcagtggattttgtatacacatatcgcaaaaagcatgcctccgctcgtcaaacattggaatcaatcctacccggacgccaaagagggcatcaaagctgcgatacagcatattaaacagctcaatgaagcacacagaaaaaaacaataaaaaagctttcggcatcaaagagaggtgccgaaagctttttttgctgaaaaggaatcaataaaggcgccgttcaattcatagcgaagaacattaatgtaactaatgcacccgtttgtttacgtatatttcttccgcttgctgaaccaagaaaaaaggaccgccgcagcaatccctttctctctttcctatatatcacatttcctttcggatacgtaataactcttcaaatgcttttatatttgtatcaaaattgggcactgtttgagattcctcggcacatttgacttgtgctacaaccaaatcatgaaaaggtgttgaaatgcccgtaccttctgccattttgggaataactccattaatataatcaatttcagttttgcgttttttctcaagatcctggagcatacttgctcttagcagcctagatggtgccatggctgacctaaaagtttggatacgttcaggaatatcattttcacttcttaattccaaagattctaaatcaaggccgcccattttcgcaaatttgacaccattggcgtgtccaaccttaatcgtctcatctgcgatatggactgcactaacaatgccgatttcatggtcaagaatgtctccgtattctccgtttaatgctgccgataaaccactgaatgcattattgataagtaattttgaccacttcgttccaactaaattatcggaaatatgtgttccgccgataaggtctaaaaccgatttaatacgctggattctttctgttgtttcaccatgtaattctccaatttgaaaagcgtactctttaaattgagtatactcagttgtaagtctggatacgcccggctcaataaacgtagcaccaaattcaacagaacctgcaataacacgttcatcaccaacgatcgaagcaactttctgttcaggtataccgttttgcaaggaacatactacactgtcatcctttaaaaaaggcagcaactctttaagaatggagtcattatataattgtttcgtcagaagtaatatgaaatcatacttgcctgacttgttttcaggggtaatggctttcacctttgcttgaaattccgttgtaccaactactttagcacctatttgatttaaggtatctacatgttctttgtatgaatcaatcaattcgacatccattccgccagcagacagatatgctccaacaatggttcctaaagaacctgctcctaaaactgcaattctcattgtcaacgctccttatttttcctctaagtagttataaaccggctgtgctgcatttaaggttaaatccgtaataatatgagatgctgaaacgacttctaatacaggcaaatctgcaagaggtgccagagcatgttcaaataattgaagccgcgccggtccagtccaggcacctttaacttctatattcgttatttgcgtccgcaccaaatcacaaacccttaaatcaccattgtaatcagtggcaatcttaaccataaaattaggtcggcaaatttcccttttcgctttttccttatccatttcgaaatgtttatatcccatagtcgcagttgccacacgaagactgccataatccaatgtgccaacaagagtatcagagtctatatacagcttaggggcacccaatttctttggatatgcagtaagttcccgtccgcttgcaatagccgggaaattgtcaacatacatagaatgtacataatctccttcttcaccattaaagctgacagggatgacttgtcctgcctctgtataggcaccaagtccggaaacatcgggcatccacatgacttcgaatttcactaaaggttcagtaatttgaagaggttccggcactgccgcacgtaaagctttttcatccgttcggtaaataatatttaaatattcacggttaacaaatttataatttgggataggataagcaggggctgttagtggcgtacttaaattttttgctatatctttcacatcaattttcattgaatgacaccctttccttttctttaactatgctattatcttacattcgcatttacatttaatccaatacataataaggtatatatatatttattgaaataaatgaggggggtgcagacagatggaattgctgcagctaaaatactttcagacagttgcctatactgaacatatttctaaagcagcagaacaattaaagattgcccagccttctttaagtctcactataaaaagacttgagaatgaactgggaacaaccttgtttgagagaaaaggcagaaatattaagctgagttcagcagggaaaattcttttaaaacatgtaaacaggatttttactgagattgaaaatgcacaaacggaaattcaattggaggaacatcaaatttctggcaccatcagaatatctatttccaatccaagattccttgcaggactgatgagtgaatatatcaaccgctctcctcaatcaaaaattctccaagcaatcggagttaaaagcgagatcataacaagtttaaaaaaaggggacattgatttaggaataacaggtcatccgattcaagatgaagagatagagagttgggtgctggtaaatgaagatattgttctggctttgccctcaaaccaccgatttacgggtaaaacagaaatttctttacgtcttgtcgccgatgaaccatttattacccttgctaataatgaagagtatagcggttttacagcctcgctttgtgagaaagctggtttcaccccaaatattgcatttgaggcagattctcatttactggtcgagattataaagctggatcaaggtgtggcgttgcttcctatttcagtttgcagaacattggggctgaattttataaaagtgactgatcactctgcttcatatccagtcggcttatcttggatgagacataagctattatcttcttcggtaagaaattttcgtgactttattatgtcgtactataaagataactatgaaatgtttaaggtttattaaagaattccatcactatttttttgaattttcaccccccatttccaatgaggcggaagactggtcattcccagatgatataaaaaaatcccgcggcatccgcgggatttttctttgttaaacggctttcgccttttcttcttgtttgcctgtctttttatttgtcagcttaattgatttaacaaacagcgtgaggatcaatccggcagcgataaaggccaggcctgtgaaaaacacgctgtgaagcgaatccatcagtgacgttttcaaaaccggcacgatatgggaagaaaatgcggccggaatctgcttaatcgattcctggctgaacaaggattgaagcagcccttcaggattcttgtcaatcatacctttaaactgggcggcaaaggcacttgcctgtttcgggagtgagtctaagtaaggcaccagtctgtcggttaaaaggcttcctgatctggcattcatgacagcgccgagcaccgtaatgccgaacgttcccccgatcatccggaaaaattggcttgaagaggtcacaacacccagctcttcttttgaaaacgtttcttgcagagcgagtgtgagaagcggcatgacgagccccattcccagaccgatcacggccatatagcatgtagccgcgagcttgcttgtatccagctgcaaagtcgttaataagaagaagccgacggccatgatcagcatgccgatcatgatttgcggtttaataccgatcttataaaccagctggcctccgataatacttgtgataatcatagataccatcatcggcgtcataatcgtgccggaagcggtggcgctgactccgataattccctgcataaagaaaggaacgaacgtaacggcgccgaacatgccgatactcatgaaaaagccgatcagattcagtacggtaaacgttctgtttttaaacaggtacatcggcagaatcggctcttttgctttgatttcagcgaaaatgaatccgacaatcccggcaagtgcaagcgcaaagagaccgagaatctgccaagagccccatgcgtaatcctttcctccgaagctgagcgcgaggaggaggctgacgattccgacgatcattgtgaaaatgccggcgatgtcaaagttaatcggcccggtctgttttctgccttgaagtcctcttgcgataaagatcacggctaaaattccgacaggcaggttgatatagaaaacccatttccaatttaatgagtcaacaatccagcccccgatttgcgggccgatcacggaagcaagcccgtaaatcgccccgaaaagcccttggaacttggcacgctgtttccctgtgaacaaatccccgatgacgatcatagccatcggcatcatgacaccgccgccgattccctgaagtccgcggaaaataatcagttccgtcatgttgctggccattccgcacagtgcggaagctcccataaaaatcaataaacctgatacatagacgacgcggcgccccaataaatctgcaagtttccccgcaatcggaacgatcgtcgtcgaagttaaaagatatgccgtggtcagccacgtcatcatgcttaatcccccgaggtcacccacgattttaggaatcgccgttcctacgatggtgccgtcaagggctgagaaaaacatggcgatgattaagccggttattaataatgtgcgttttggatctttcttttcaatgctcatgtttcggcagctcctcttttctattcgttttctttttgatcagccgcgtatttctcggctgcttccgctactttgcggatgatgttcacggactgaatcagttcatcgtcagtcagaacggataggtttcgcgccagtatcgctttccgtccttccacaacatcttcgaattttgtttcgccttttttggtgaggctgatgtcgatgacgcgtctgtcctgctggttatgtttgcggacgataagtcctttttgttcgaggcggtcggccatcagcgtcactgcactcggctttacctccatgcgttccgcaatttcggaaactttgcagctcccgtgttttttcaggctggctaaaacaaataattgggcaggcgtcacctcgtgttttgccatgctttccaccatttcaggctgtatgttttgcagcagcgtctgaagagatttctggatgtcagacacatattgatccgcgtttttcataactcctcctcatcttgttccttgggaaaataattaacattagttaaatataaataaggattaatgataagtcaatctttttgtgcaaaaataaaaaaaggattgatgcttgtcgaaaacatcaaatccttcttcgttttactgctggtagggagactgctgctgaatggtctgccggaacttctgatacgattgctgaagcttttgggtatcggctgcttcaatggaataccagccattttgaaacatcacatcgtataatcttctttgcgctttttgtgactcatcgaaaatcgcctgaatatcttgataaagagactcgtggctgaactcgtgcagggctgtgcaatatgaagccgtgatgtatttttccgtcgtcagcagctcattcaccaagtctctgtcattcatttgcgccgtattgggcacaggcgtttgcggattcgtgattttttggttttgctgttccatgtattgtcctcctattgcatatagcctgttgttgtctgtccgccttgatcggggttcaagcggcctaatatgtgctgataatgcttctcatgcatccggccgatctgatcaagctcttgttttaacgtctgattctggcagtgttccgccataaaatgcgcttttttcatggcaagcagattccagttcagcatgtcctcaagatacaaatggtctttcgttgagatgacggcaggcggcaagtttccgtgctgctcttggttgttcatttaaacgcctccttcaattctgttctttttagctttctctgcgatcggaaattcatacacgaataaaagaaaaaggagggagttcatccttgctgcggagcatatgtttatttttgtcgaaaaataaaatgcttacaaaattcgcccaggcttacggaatccgcttcggtgcgggaaggttcgttgcaggggaaacactcacggaagctgtgaaaacggtaaagcggctgaaccaaaaagggctgtcggcttcgattgattatctaggtgaatatgcgggttcagagaaggatgcgagaaggacggcggaagaatgtaaaaaagcaatcagggcgattgccgagaatcaactggattgtgagctgtcgctgaaattaacatccatcggtctggatatttccgagaagctcgcggaacagcatgtcagagacatattgacggaggcaaaagaacgctgcgtgcctgtaacgattgatatggaggactattcaagatgcagccgtacgcttgagctgtataagcggtgcaagccggatttcccgatgctcggcaccgtcattcaggcttatttgtaccgcgcagctgaagatatcagcggtctgatgccatacaagccgaggctcaggcttgtaaaaggcgcttataaagaatcggcggccgttgcattccctgataaaaaagcaaccgatcttcattttcagcagctgattaagctgcagcttttgagcggccatgaaacggcggtggcgacacatgatgatgacatcatttcttatacgaaaacactcatcagcgaacatcagattccccgggagcagtttgaattccaaatgctgtacggcatcagaacggagcgccagaaggagcttgccgaagaaggatacaggatgagggtgtatgtcccgtacggaaccgattggtacgggtacctgatgagaagaattgccgagcgcccggcaaatgcggcatttgtgctgaaagggatcttcaaaaaataacggctgctccaaaaagcagccgcagcatgttattccatgttgtcttttttatattgctgattttggctcgtccgtttgccgccgccgtatttttgtttcggtcccgcatttcctttcatgctggccgcgctcactgcggcagaagacggatcttttctccctcgcaccattcccttcacctccgggtttaagtttcccgcccgcgccatggaacatgcggaagcagaaaaatttaaaaaaattccatatttgctattgaagtcatcctgaaaatcttttaagatgaaagaagaaaagggtttcattttttttgccgaaaaaatgaatgactattcattcaaagttcaagggggatgactcatgcacaagtttataaagaaagcagccgttctcggatcaggcgtcatggggtccggaattgccgcgcacttggctaacatcggaattcccgtcctgctgcttgatattgtgccaaacgagctgacaaaggatgagatgaaaaaagggctgacattagaaagcccggaggtccgcagcagactgagccgatcggccatgcaaaagctgctgaagcaaaaaccggcgccgctgacttcggctgccaatctcgactatataacggcggggaatttggaagatgacgcagctcaattgaaggatgctgattggattattgaagtcgtcgtcgaaaatcttgacgtaaaaaaacagattttctcactcgttgatgaataccggaaaccgggaagcatcgtgtcgagcaatacgtccggtatctccgtcacaaaaatggcggaaggccgatctgccgattttaaagctcatttcttaggaacccatttctttaatccggcccgctacttaaagcttctggaaatcattccgattcaggaaacagatcctgacgtgctggagtttatgacttcatttgcagaaaacacgcttgggaaaggggtcgtcatcgcaaaagatacgcctaattttatcgccaaccgcatcggtacgtacggcctgttggtcacggtaagagaaatgctttcttccggctgccgcatcggcgaggtggacacggtgaccgggcctttgatcggcagaccgaaaagcgcgaccttcagaacccttgacgttgtggggcttgatactttcgcccatgtggcaaaaaatgtgtatgataaagccgacggcgctgaaaaagacatgtttaagcttcctgaatttatgaatgacatgctgaaaaacaattggctgggcagcaaatcaggccaaggtttttacaaaaaagaaggtaaaacaatatatgaactcgatccgctgaccatgacatacggtgagcgctcgaaaatgaagacacccgctttagaagccgccaaacaggcaaagggtgccaaaggcaaaatgaaagcgcttatatactctggtgaccgcgccggacgcctgctttggaatattacatcgcaaacactcttatactcagccaggcttttaggtgagatcgctgatgatatcaaagcgattgacgacgccatgaaatggggcttcggatgggagctcggcccgtttgagatgtgggatgccatcggcgtcagaaaatcagcggagcggctcgaagaagaaggcgcagcactccccggctgggtgaaagaaatgcttgatcagggccatgaaacattttatatgaaggaaaacggaacaccattttactattcagacggccaatacagggctgtgaaagaaaatccgaaacggatcagcctgcaaacgttaaaagaaacaaaaggcgttatcagtaaaaacagcggcgcaagtctgattgatctcggcgatgatgtcgcgctgctggaatttcatacgaaaagcaacgcgatcggcttagacattattcagatgattgacaatgcgcttgaggaaacggagcggaattataaaggtcttgtcatcggtaaccaaggcagacatttctgcgcgggggcaaaccttgcgatgattttgatggaagctcaggatgataacttcatggaagtcgattttgtcatccgccgttttcagcagacgatgctgaacatcaaatacagcgctaaacccgttgtcgcggcgccatttgggatgacactcggcggcggcacggaagtctgtctcccggcggcacgcgttcaggcggcgagcgaatcgtatatgggtctcgttgaaaccggcgtcggtcttattccgggcggcggaggaaacaaagagctgtacatgaattatttggacggcggaagtgaactgatggacgcagcgattaaaaccttcgaaacaatcgcgcttgccaaagtgtccggttcggcacacgaagcccgtgatatgcagattttgtccgcggctgaccgtgtcagcatgaatcaggatcacctgctgcacgatgcgaaacagctggctgcttccttatatgacagcggataccgcccgcctgcccgcaaaaaagtgaaagtcaccggggaaaccggatgtgcggcattactgctcggagcagaccaaatgagacggtcgggttatttatccgatcacgatatgaagattgcgaagaagctggcccatgtcattgccggcggaagagtcccgttcggcacggaggtttcagaagaatatttactcgagattgaaagagaagcctttttaagcctcgctggcgaggcgaaatctcaagcgagaatgcagcatatgctcgtcaaaggcaaacctttacggaactaggagggtgtttatgagagaagcagtcattgtggccggtgcgagaaccccggtcggtaaagcgaaaaagggatcgcttgcagccgttcgtcctgatgatttaggcgcgctttgtgtaaaagaaacgctgaaacgggcaggcggatatgaaggaaatatcgatgacttaattatcggatgtgcaacacctgaagccgaacaaggattaaatatggcgcggaatatcggtgcgctggcggggcttcctcatacggtgccggccattacggtgaaccgctactgctcttccgggctccaatccatcgcttacggtgctgaaaaaatcatgatcggcgcgggtgacaccgtcattgcgggcggtgcggaatccatgtcgcaagttccgatgatggggcatgtgacccgcccgaatatcgctttggcggagcatgcgcctgagtattacatgagcatggggcacacagcggagcaggtagccgaaacgtacggcgtatccagagaagaccaggatgcatttgccgtccgcagccatcagaatgccgcaaaagctcttaaagaagggaaattcaatgacgaaatcgtgccggttgaagtatcgctgacagaagtcggtgatgaccataagccgcggaaaaaacaatttaccttttctcaagatgaaggcgttcgtcccggcacatcggctgacgtcttggcgaagctccgtccggctttttctaaaacgggaaccgtgacggccgggaactcttcacaaacaagtgacggcgcggcggctgtcatgctgatggatcgcgaaaaagcttcgtcgctcggattggcgccgcttgtcaaattccgttcctttgccgtaggcggcgttccgcctgaggtaatggggatcggtccgattgaagccatcccgcgggcgctcaagcttgccggactcgaattgcaggatatcgggctttttgaattgaatgaggcctttgcttcacaggccattcaagtcatcagatcgcttgggatagatgaagaaaaggtgaacgtcaacggaggcgccatcgcgctcggacatccgctcggatgcacgggaacgaagctgaccctgtcactcattcatgaaatgaaacggagaaacgagcaattcggcgtggtgacgatgtgcatcggaggcggcatgggagctgccggcgtatttgaactcatttaaaaaaagggggaaacgaacatgaaacaggaaacggtcaacgtcaaaaaaggcggcagctttctgattgaagagacgggatatgatcaaatattcactccggaggactttacagacgaacacaaaatgatcggcaaaacgacagaagactatgtcgtaaacgatgtgcttccttatatcgatgaaattgaaaaccatcagttcgagcattcggtcagactgctgaaaaaagccggagatctcggcctcctcggagcagacgtgcctgaagagtacggcggaatcggcctggataaaatcagttcagccttcattacggaaaagttttcacgtgccggcagcttttcgctgtcttacggcgcccacgtcgggatcggctcattgccgatcgtgttcttcggaacggaagaacagaaaaaaacctatttgccggacttggcttcaggacaaagaatcgcggcatacgccttaactgagcccggttcaggttcagatgccctcggcgcgaaaaccacggctgttttgaatgaagcgggcacacactatattcttaacggagaaaagcaatggattacaaactccgcctttgcagatgtctttgtcgtctacgctaaagtggacggagataagttttctgcatttatcgtagaaaagaactatccgggcgtgtcaacgggaccggaagagaaaaaaatggggattaagggttcatcgacaagaacgctgattttagatcaggcggaagtcccaaaagaaaaccttctcggcgaaatcggaaaaggccatgtcatcgcttttaatatcctgaatatcgggcgctacaagcttgccgtcggcacaatcggcgcttcaaaacgggtgattgagctgtctgccgcttatgcaaaccagcgccggcaatttaaaacgccgatctcaagcttcacgctcactcaggaaaagcttgcgacgatgtcagctcggctttacgcgatggagagctctgtatacagaacagtgggcttattcgaagataatatgagcagactgacggaagcggagcaaaaagacggacgcgaagtcgcgaagtcaatcgccgagtacgcgattgaatgctcgctcaacaaaatgtgcggttctgaaacgcttgattatattgccgacgaaggcgttcaaattcacggcggttacggatttatgcaggaatatgaagtggagcgcgcctatcgcgactcaagaatcaacagaatttttgaaggcacaaatgaaatcaaccgcctgatcgtaacgagcacgttcctgaaaaaagccgtaaaaggtcagctgccgctctttgaaaaagcaaaagcgctccaagaagaactcatgatgctgatgcctgaagagccgggctcggagcctcttggacaggaaaaatacattgtcagacaggcgaaaaagatcgccctcttgacagcgggtctcgcggcgcagaaatacggaaaagagatcgaaggcgagcaggaaatcatggtgaacattgccgatatcgtcagcgcgctgtacgctttggaatcagccgtcctcagaacggaaaaagcgattgcggcggacggtgccgaaaaagccgcgcagaagctgttatatacggaaatctttgcccaggaagcccttcagaacattgaagcgcacgctaaagaatcactgatcgccatggaggaaggagattccctccgcatgatgctttccgtgctgcgcaaactgacgcgcctgacgccgaaaaacctcattcagaaaaaacgtgaagcggcagccgccgtcttccgtgaagaaaaatatacagtctgatcacatgctgaaagcgctccttcatcaggggcgctttttcatgaagcaacgttataggtttttacaagtgattgtgttaaaataacgacgatcatttacaaggggtgaagaagatgtcgttaaatttttactggtaccctaaatgcggaacgtgccgtaatgcgaaaaaatggctggaagaccgcggtaaggaaataaacgaaatacatatcgcggaggaaactccgtcgaaagaagaaattaaagacctctatgaaaagagcggtcttgagctgaaaaagtttttcaacacgagcggaatgaaataccgcgagctgaacttaaaggaaaaactgtaccatatgtcagaggatgaacagctcgaacttctggcatcagacggtatgctcctgaaacgcccgattacgacagacggcgaaaaagtcactgtcggctttaaagaagaccaattcgaaaaatattggatgtaatgccaggttcaaagaattatggtatcttcttattataagaaaaaaatggagggatttagatgagcacaccgaaagatatgcgttattccaaagagcacgaatgggtcaaagttgaggacggaaaagcccgcatcgggattacacatttcgcgcaagccgaacttggcgacatcgtctttgtcgagcttccggaagtcggcgccgaaattaaagcggacgagccattcggcagcgtggaatccgtcaaaaccgtttccgaactgtacgcaccgattaacggaacggtgacggaagtgaacgaagaccttgatgacagtcctgaattcgtaaacgagtctccgtatgaaaaagcgtggatgatcgtcgtggaaccggctgatgctgaagaaatcgaaaacctcatgacttccgagcaatatgacgaaatgacacaagaagactgatcggatagcaaaggggccatttggacattctatctgtaacgggaggtgtctaaaatggcttttgataaacaaaaggtcgatgtgacggagaacgttacgggccgctttcaaaacggccggttttccttgtttcatgaaaatgaagccatcggcgagatgacaggcatggaccagtacgagctcaaacagggcttttcatttgaaaatcaaaaattttataaaacagccgatgtcataaacggcagcgatccgaaatatgtcgattgcgattatgagaatggctggtgttaacagttggcggtgaatttcactgccttctttttcaatctgacgctaaaacaatcggcaggtgacgcgcttatgtacaacggagatgaaaaggtcattatcgtagaaggaaaatctgataaaatcaaagtcagggaagtgctcatcgaacccgcggaaatcgtctgtacaaacggaacgatcggccaaaccgaactggaagatttggcggaccgcctgtttgacagagacgtctatattttaacggacgcagatgactccggagaaaaattaagaaaacagctgaaacgggagcttcccgacgcgcgccatatttatatagacagaacatacaggcaagtcgagtcgtgcccgggccatcatctcgcatctgtgctgatcagagccggctttgatgctgacactgtatttttgaaaaagaacgacctgaggtggtaatcatgaaagaactccaagaaaatgaactcgaatcgattcaggatgacgtttatctcctgtatttgtacaccccgttttgcggcacatgccagctggcgtccaaaatgcttactgtcgtcgaagaaatgctgcccggcgccgccttctataaaaacaacgtgaattattcccccgcattcgccaaagcctatcagattgaaagcgttccgtgctttttgctgtttaaaggcggagagcttgttgagaaaggatacgccttccgctccgtttcctatttatatgagctgattaaacaaaaaacatcgcaaacgttcccgatgtgacaatatttacaggaaaatgtcgtgcggtttataaagggttctgtccgttaaaaagagaaagtgtatgtatggccattaaaacgggaggttatacgagtggagaaaatagaagtttcagagaatgacggacagcatctgtttttgaaaccgctattaaacgcctcaacgcttctgattacattccaaggagaaacagaagccttaacggtctcaattaacggacagggagaaatgagaaaaacgtcggtttcaaaggaaaaatctaatttgaccttttacggaaaccagacggaaatcattcatctcctgcatggtgatgtctctttgcaaaagcttatccaaagcggaaaactcaaagtgaaaggatcattcagagctctgctgaagctggaggccatcctctggctgacaaacggattttttcaggcgatcagtaaacggccgtaactcaatctactatgtgacaatagcttccaatatttattttattgactttttatcattcgccgtgctattctacagtaagaatttccggacgaaaatacgatatgttttctcttatcaagagaggtggagggaagtgccctatgaagcccggcaaccatcaacaatgttgaaatggtgccaattcactcgaagcggtctgctttgaaagatgagagaaaggcctttttcaataagcctttctgctcatttttgcagaaaggcttttcttttgcggagaaacccggaagatttcttagaatagtgtaaggcgggtgattgctttgatccatcttcaaaatgtttcaaaaatttacaaagcgaagcatggggatgtcaatgctgtccaagatgtcactcttgatatcaaaaagggcgaaatatttggaattataggatatagcggagctggtaaaagttccttaatccgtctcctgaacggccttgaaaagccgacgtcgggaaccgtggaagtcgcggggacggaattaaataaagtaagcagccgcgggctgagaaaagcgcgccaggaaatcagcatgatcttccagcattttaaccttctgtggtcgcgcaccgtccgggagaacattatgtttccgctggaaatcgccggcgtgaaaaaaagcgaacgggtccgccgcgctgatgaattgattaaactggtcggattagaggggaaagaaaaatcttatccgtcgcagctgagcggcggtcaaaagcagcgtgtcggcatcgcccgggcgctcgccaataatccgaaagtccttctgtgcgatgaagcgacatcagcgctcgatccgcagacgaccgattcaattttggatcttttatccgatataaatgacagactcggcctgacgatcgtgctcattacccatgaaatgcacgtcatccgaaaaatctgcaacagagtcgcagtcatggaaaacgggaaagtcgttgaagaaggcgaagtactccaagttttcagaaacccgcgcgaaccgatgaccaagcgtttcgttcagcaggtgacagaaccagaggagacgaaagaaaccatccagcattttctgcaggaaacagcgacaggaaaaacgattcagctttcatttgtcgggcaggcagccgagcagcccctcattacggaaatgatccgaaactttgatgtggacgtcaatattctgcaggggaaaatttcacagacgaaggacggagcctacggttctttattcattcatattgacggtcaggaaaaagaagtagaaaacgtgatccggttcatcaaagacaaacaggtagaagcagaggtgatcacaaatgtttgaaaaatggttcccgaacgttgatataaccgagctgtggacggccacatacgagaccctttatatgacggtcatcgctttagttttttcatttatcatcggagcggttctcggtcttctgctctttttaacgggcaagggaagcttatgggaaaataaaatcattaacaccgtgattgcggcggtcgttaatattttcaggtctattccgtttcttattttaattattctgcttctcggctttactaagattttggtcggatcgattttaggaccgaacgccgcattgccggcgctgattatcggctccgcgccgttttacgcccgtcttgcggaaattgcgctccgggaagtcgataaaggagtcatcgaagctgccagatcaatgggagcaaagacatcgacgattatcttcaaagtgctgattcctgaatcaatgcctgcgttaatttcaggcatcaccgttacggccatcgccctgatcggatctaccgccattgccggcgccatcggttcaggcggactaggaaaccttgcatatgtagaaggctaccagtccaataatacggatgtaacgtttgtagcgacagtatttatactcatcatcgtctttatcattcagattatcggtgatgtaattacaaatataatagacaaaagataagggaggatttacattgaaaaagattgtattaagtgcgctgctgcttgtgttcgcgggagttttggccgcctgcggatcaaacggctcgaataaaaaggaaatcgtcgtcgccgcgacaaaaacaccgcatgctgaaatcttaaaagaagcggaaccgctcttgaaggaaaaaggctacacattaaaagtaaaagtgctgaacgattacaaaatgtacaacaaagcgttagctgataatgaagtggatgcgaactacttccagcacgttccttaccttgaacaggaaatgaaggaaaataaagattacaaactcgtgaatgccggagccgttcaccttgagccattcggaatttacacgaaaaaatacaaatcactgaaagacctgcctaaaggcgcgaccatcatcatgactaacaatgtcgctgaacaaggccgtatgctggcgatgcttgaaaaagccggactgatcacacttgatccgaaggtgaaaacgattgaagcgactacgaaaaacattacgaaaaacccgaaaaacctgacattcaaaaaaatcgcccctgaattaacggcgaaagcatataatgaagaagaaggcgatgcagtcttcattaacgtcaactatgcgattcaaaacaaactgaatccgttaaaagacgcgattgaagtggaatcaacgaaaaacaacccgtacgcaaacatcatcgccgtacgcaaaggtgacgaaaaatcagagaaaatcaaagcgcttatggaagtgcttcactctaagaaaatcaaagacttcattgagaaaaaatacgacggagccgtgcttcccgtatctgaataaagcgaaaaccccggatgagtcatccggggtttttttcgggtattaatcggagaactgtccataataaaagggaaggttaacttattggagggaatggcagtggctcaataccaggataacggcaaaagcgtgcatgacgcgttaaaacaatacaaagaaggtttaggcatatttgaacaaaaaatgccgatgatggggcggaagtttaatgaatttactgaacagtgtttctcagcggattcattaactgaaaaagagaaacaattaatcgctctgggtatcagcatcagcgctcaagatgaattttgcatgatttatcatacgaagggctgccttgaccaaggggccacagaagaaaacatccttgaggtcatcagcgtcgcggcggcattcgggggcggcgcggctctcagtcagggagtgaccctcgtgcagcagtgcattcaggaattcggacatacgacgcattagaatgagcaatcgtgtgaataccgtttttcagataaagtgagcgccggtttccggcacattcgaaaggattcaggggcacactctctttggccggagcaggggatcattgttacaatagaaacaaatatatgaagggattgattcattatctgcaccagccacgagagactggaccttgactatacgcctgaaatggaaaaagcgatgcagaagtcacacggcatcggctacgaggaatacggacggcgtctttcaaaaaggatggaagtcgaacggcagagggagcttgaatatcaaaaaagcaagttcctcgcagcgcagcttaatgagaaaatcggtcagtaaaaaagggtggatttccgccctttttctgtttcaaacagctttaattacgccttgatctttgataaactttaggaatgttccgggtaatataaaaagttgtatttacttttcatttgttataaaattagaatgagaataaattgagaataatgattatatattttggaggtatagatatggctgcttcaacattaacgatcaaggatcttcacgttgaaatcgaaggaaaagagatcttaaaaggtgtaaaccttgaaataaaaggcggcgaattccacgctgtcatggggccgaacggtaccggtaaatccacgctttcagcagcgattatgggacacccgaaatacgaagttacaaaaggcagcatcacgcttgacggcaaggatgtactggaaatggaagtggacgagcgcgctcaggcgggtcttttcctggcgatgcagtacccaagcgaaatcagcggtgtgacaaatgccgatttccttcgctctgcgattaacgcacgccgtgaagaaggcgatgaaatttctcttatgaaattcatccgcaaaatggacgaaaacatggagttccttgaaatggaccctgaaatggcgcagcgttacctgaacgaaggtttctcaggcggggagaaaaaacgcaacgaaatccttcagcttatgatgatcgagccgaaaatcgccattcttgacgagatcgattcaggtcttgatatcgatgcgcttaaagtcgtttctaaaggaatcaacaaaatgcgcagcgaaaacttcggctgcttaatgatcactcactaccagcgccttctgaactacatcacgcctgatgtcgttcacgttatgatgcagggacgcgtagtgaaatccggcggcgcggagcttgcacagcgccttgaagcggaaggttatgactggattaaacaagaactaggcattgaagacgaaactgtaggccaagaagcgtaagcgttagggggataatcatgacattggaaacgaaactatccgtagatcaggaatatgtcaaaggcttttccgaaaagcatcaagaacctgcctggctgaaaaacctgcgcttacaggctcttgaaaaagctgacgatctgccgctgcctaagcctgataaaacaaaaatcacaaattggaactttacaaagttcaacaagcatacagtagaaaatgcgccgcttgcttctttagaagatttagctgatgaagcaaaagcgctgatcgatatcgaaaacgaagacaaaacgttatacgtgcagcgtgaccaaacgcccgctttcctttctctttccaaagaactgaaagacaaaggcgtcatctttacggacatcttaacggctgcccgtgagcacagcgacctcgttgagaagtatttcatgaaagacggcgttaaggtcgacgaacataaactgactgcgcttcatgcagcattaatgaacggcggggcattcctttatgttcctaaaaacgttcaggtggagacgcctgttcaggccgtttacgttcatgaaagcaatgacacggcattgttcaaccacgtgctgatcgtcgctgaagaccacagctccgtcacttacgttgagaactacatcagcacggtgaatccgaaagaagctgtattcaacattatcagtgaagtggtcacaggtgataatgccagcgtgacgtacggtgccgttgacaacctgtcagcaggcgtcacaacatacgttaaccgccgcggagccgcgcgcggacgcgacagcagaatcgagtgggcgctcggactgatgaacgacggcgacacgatttctgaaaacacgacaaacctctacggagacggcacatacggcgatacgaaaaccgtagttgtcggaagaggagaacagacggaaaactttacgacgcagatcatccacttcggtaaggcttctgaaggctatatcctgaagcacggagtcatgaaagatgccgcatcttccatctttaacggaatcggcaaaatcgagcacggcgcgtctaaagcaaacgctgaacaggaatcccgcgttctgatgctgagtgaaaaagcacgcggagatgcaaacccgattcttttaattgatgaagacgatgtaactgcaggacatgcggcatctgtcggccgtgtggacccgatccagctttactacttaatgagccgcggaattccgaaagaagaagcggagcgcttagtcatttacggattccttgctccggtggtaaaagagcttccgattgaaggagttaagaaacagctcgtctccgtcatcgaaaggaaagtaaaataatgaatatcaccgatattcgtgaacagttcccgatccttcatcagcaagtgaacggacatgacctcgtgtaccttgacagcgcggcgacttcccagaagccgcgtgctgtcattgaagcagtggatcagtattacagcaaatacaattccaatgtccacagaggcgttcatactcttggcacgagagcgacagacggctatgaaggtgcgcgtgaaaaagtccgtaagtttatcaatgcgaaatcaatggctgaggtcattttcacaaaaggcacgacaacttcactgaatatggtggcgctgagctatgcccgcgccagcttaaaacccggtgatgaagtggtcatcacccaaatggagcatcatgcgaatatcattccgtggcagcaggctgtaaaagcaaccggcgcgactttaaagtatatcccgatgcaggaagacggcacgctttcgttagacgacgtccggcagactgtcacaagccatacgaagatcgtggcagtcgctcatgtgtcaaacgtgctcggcacgatcaacccgattaaagagatcgccaaaatcgctcatgacaatggcgcggtcatcgtggtggacggggcgcaaagcacaccgcacatgaaaatcgacgttcaggacttggattgcgacttcttcgcgctttcttcccataaaatgtgcggcccgacgggaatcggcgtgctgtacggcaagaaagaactgcttgagaatatggagccggccgaatttggcggcgaaatgatcgactttgtagggctttatgaatcaacttggaaagagcttccgtggaaatttgaagcaggcacgccgattatcgcaggcgcgatcggattgggagctgcgattgattttcttgaagagatcggactcgacgagatttcccggcatgagcataagcttgcagcctatgcgcttgaccgtttcgagcagctagacggcgtgacggtatacggtccgaaagagcgggcgggacttgtgacatttaatcttgatgaggttcaccctcatgatgtcgcgactgtcctcgatgctgagggcattgcggtcagagccggccatcattgcgcccagccgctcatgaaatggctggatgtatctgctactgcgagagcgagtttttatctgtataatacagaggaagagatcgataagctcgcggaagccctccaaaagacaaaggagtactttacaaatgtcttttaatgcaaatttagatacattatacagacaagtgatcatggatcattacaaaaatccgcgcaacaaaggggttttggatgacagcatcgtcgtcgatatgaacaacccgacttgcggcgaccggatcagactgacaatgaagcttgacggcgataccgttcaggaagcgaagtttgaaggggaaggatgttctatctccatggcttcggcttccatgatgacgcaggcgattaaaggaaaagatattgataccgccctttccatgtctaaggttttctcagacatgatgcaagggaaagagtatgacgactcgatagatctcggggatattgaagctcttcaaggcgtttcgaaattcccggcccggattaaatgtgccaccctttcatggaaagcacttgaaaaaggagtcgctggcgaaaaaggcggcaattaaaagattggagtgaaaatggatggctaaaaaaatgcctgaaattggtgaatacaagtacggttttcacgataaggacgtttccattttccgttcagagcgcggattgacaaaagaaatcgtagaagaaatttcacgcatgaaagaagagcctcaatggatgcttgatttccgcctgaaatctcttgagcatttctacaacatgccgatgccgcagtggggcggggatttaaactctttaaactttgacgaaattacgtattacgtaaaaccgtctgagcgttcagagcgttcttgggatgaagtgcctgaggaaattaaacagacattcgacaaactcggtattcctgaagctgagcaaaaataccttgccggtgtttctgcacagtacgaatccgaagttgtttaccacaatatgaaagaagatcttgaagagcaaggcatcgtcttcaaagacacagacagcgcgctgaaagaaaatgaagacattttccgcgagcactgggcgaaagtcattccgccgactgataacaagtttgcggcgctgaactcagctgtttggtccggcggatctttcatctacgtgcctaaaggcgtgaaggttgaaacaccgcttcaagcttacttccgcatcaactctgaaaatatgggtcagttcgaacgtacgctgatcatcgttgacgaagaagcaagcgttcattacgtagagggctgtacggctcctgtgtacacaacaaactcgcttcacagcgcggttgttgaaatcatcgtcaaaaaaggcggctactgccgttatacaacaattcaaaactgggcgaacaacgtttacaacctagtaacgaaacgtacggtttgtgaagaaaacgcgacgatggaatgggttgacggaaatatcggttctaaattgacgatgaaatatccggctgtcattctgaaaggtgaaggcgcgcgcggcatgacgctttctatcgctcttgcgggtaaaggacagcatcaggacgcaggcgcgaaaatgattcaccttgcaccgaatacgtcatccacaatcgtatcaaaatcgatttccaaacagggcggaaaagtaacataccgcggtatcgtccacttcggacgaaaagcggacggcgcccgttcaaacatcgagtgtgatacgctcattatggataacaaatcaacttctgatacaatcccttacaatgaaatcctgaacgacaacatttcattggagcacgaagcgaaagtatcaaaagtttctgaagaacagcttttctacttgatgagccgcggtatttctgaagaagaagcaacagaaatgatcgttatgggcttcatcgagccgttcacaaaagaacttccgatggaatacgcagttgaaatgaaccgtttgatcaagttcgaaatggaaggctccatcggttaatagtaaaaccccgccatttggcggggttttttgtttattggatagtgaaattaccgtattcgcttgaccggacatgaatcggcccgtttaaattgtagttcttctctttgacaatatcgcggaaaacgtcgacacgggcaaccgattctctccattcatcctgagtatcctcatctgacggattcatcagatcgtcatagcgcacatccaagaatttattgagccatttcttctcgtcaattccatctttcggtgacccgcccatttttttgttcgtgcgtttaatcagggcataaaaggagtctggatcatcgccgtcgccatgctgaatcaccgtatcgtacatcactgcttttgccaaggccgttttcagtccggcattttctgaacgtttcatcgccggctgataatacaagctgtcatttaccttatcctgggcagcgcggaaggctttatcattgccaagtgagcgccaggcagaagcgaatcctttcagattgctgatgtcatcgctttcgtccttcgcaagacgccgcaattcaggcaaatactttttcaatttgttattcggcaccgctttcgtgtatacttcgactacttccagcgcatctccggtagccgtcgtaaagccggcccgcccgcaagtgtaacctcttccgtcatccaacgcttcaatatatccgtattggatttccgtctttccgttttcaaagatgctggtcagctgttccgcccggcgcttctgatccttattcagcccggccgcaaaaaccgtaccgctcatcatcagggtaaaaaacatggtgaaaataagtgacgaaaccgccgtcttcttccaaaaacctgcttttttcttcaagctgattttcattgccatacccctttcatatgtaagttacgcactcagtatacatgagggggttgtttttttgttgaaaacacacgaatttgtcaatattttgaatcctaagccctatcaggcgcttcataaaaaggacgcaccttcatcagacagacaatcccgttctcgcgtcattctcatctgtaacatagtcaacgcggagaaatccgcattgtacagcctgctgataaagggcttcgagcatatccggatctttgcaatataacgttacatacgagcaatctgcaatgagaagcacaagctcacaggaactctccaaatactcctcgtacgtattgatttccgttaccatcccgcccgggaaagctttcaattcagcaaaaatcatataataagggtttccttccagacgctgacggagttcttgaccctgaatgatgcgctgattttgcggaaacaggtctgtatcgatgccttctttgaattccgtatacgcctctccatcaccgataaaccacgtataggaagagatggggaacggttgtaatatatctgccgcaaaccgcccgaattgatttgggatgttaaatgtaatgccgcgtttcatatggtcgtatctcctttcggcttttgctagaataatatggtataccatttggataaatattgaaaggggtgggtgttatgacaacacgatacggaattgatgcgccttatggagcgtttggatttatctttattgcgctcctttatgccgcaggcacgttatacggcatgattcctccttactggggctggctgacgggcaccttgtttttattgctcggtctttggatgctcttgtattcaacggccattaaacttttacaccgccatcgcattcttgcgctatccggtttaaagccggacatgaaggtgcttgatgtcggtacggggcgggggctattagccatcgccgcggctcaaaaaggcgctgacgtctcagcgattgacaaatggtcaagctgggacctggtcggaaacggaagagacgcatttgaaaagaacagacaggctgaaagagcgccggaaattgatttgtatgacggactggcgcaagacatgccgtttcctgatgagacgtttgatcttgtcatttcgcattttgtcgtacacaacatttcaggcagaaaaaagagggaacgggcgattgcggaaatggtgagggtgctgaagcctggcggcattttggccgtgtcagatataaaaaatacatcacaatacagagagatttcttgaggaaaacggctttcagacaagaacgtattccttttattatacgtttccgttttcgaaactctgtcaggactccagtaggaaccgggcgctccatttgttaaaataaataagacaaaacagatagaaaaggtgttacacatgaagtcttatataattatcggagccggcattctcggtgcgtccgcggcttatcatctcgcaaaggccggtgcggatgtaacggtcattgatcggaaacacccggggcaggcgactgacgccgcggcggggatcgtctgcccgtggctgtcgcagcgccgcaatcaggcatggtatgcgatcgcaaaaggcggagcccgctattataaccaattgatacagcagcttgaagcggacggagaaacagaaaccggttatcaaaaggtcggagccgtcagcctccatacggatgaaaaaaagctcagccaaatggaggaaagagcttataaaagaagagaggacgcccctgaaatcggtgacattacaagactgactccggaagaaacgaaggcgctgttccccgcgctgtcggaggaatatggggcggttcatgtcagcggcgcggcccgggtgaacgggagggcgcttcgtaaggcgctgttaaacgcggccgttaagcacggcgcggcggtttacaatgaagaagcgtcaatattgacagaggacggtgccgtcatcggtgtgaaaaccgcagaacgcacgcttactgccgatcaggttctcgtaacggccggcgcttgggcgggagagctgcttgagccgctcggcatccgcttttcagtatcatttcaaaaggcgcagatcgttcatttagagcttcagggagaggatacgggcggctggcccgtcgtcatgcctccaaacgatcaatacattctcgcctttgacagcggcagaatcatagcgggcgcgactcatgaaaacgataccggcatggatttgcgggtgacggccggcggtctccgcgagatttttgacaaagcattaaccgtggcgccggggctttcagacagtactgtaatagagacaagagtcggtttcaggccgtttactcccggttttcttcccgtcatcggcaaagtgccgaatatcagcggactcctcgttgccaacgggctgggcgcctcaggactgacgagcgggccgtatctgggggctgaactggcgaaactcgcgctcgggcagcagacggaaattgatttgagcctttatgatccggccggggcgcttgaataaaaaatagcttttggcgcattcttatgataggatggagctttaatgaataagaggacgtgacccatttgataaaaataaaccttcctgctcctgatgtaaccattacggaacggcagcagtcaccgtcggagaatgaaccggcgattaaagcgatttacggtttcattgattttcaccaaattccgagagacaaaggcggcatctttatgttttataacattcatgatgagctgctgtttgtcgggaaagcccgtaaattaagacaaagaatcaaaaagcattttgaagacaatgtgtcgcctgttaaacatcacagggacgaagtgtataaaattgaagtatgtgtcgtaaatgatccgatggaaagggagatttacgaaacgtacgcgatcaatacccttcagtcgaaatacaacattgagaaagtattttataaataagaaaaaccggagcttaagggctccggttttctttatgtttacagtgccagccacatcacggcaatatgcacgatcagcagacagtaaacgacgaggaatagctggacgaccttttttctgaataacatgcagatcatcatgagcacgggaaaaatcaggacgccggccgttttattgattgatgtattcggacggttcgacacgtcatagtgaatggccatatcagcaggaagaaacggataaaacacaatcgacagaataaaggcgagaactacagctccccacagcactttatcattcatcaaaaacatatgaacactcccttttttacatataatagtatattagtccgaaaaatctaatttatcaatattttacctgttgattggtgtataatcatgtcaatgaaatttccatacgctaggagggtttcaattgactgacaagaagcaaaccagcatgttttcattctttctttttatcatggccgcctggatcatcgttttgttttttaccgtcatcgcggcactgccaagctccgccatccaattaaccaagcatcaatccaaaaccgtttccatgatttatccgcaaagctggggatttttcagtaaagatccgagagaagacagcttgaatatctatcttcttgatgccgatgaggagctcagatggccgaataattctctgaaaaatgtcatcggcttaaaccgctacggccggacgcaagggatagagctcggccttatgctggaaaagctgccttccaaagagaagtggaacgacttcacgactggccaagacattaaggataccacatttttgaaaatgaaaaatgagtctccctccccaaggctgaaagggaaaatgatcattacatatgaacgcattaccccatgggcatggagccagcataccgaaacgaaaagaaccatccaaaaatacatcggagtggatgtcaattgattcaggatgcaaaaaagcagctcaccttatggatgatgaagaatccgccttggacaaatgtgtacgggcttgccagaagcttaatcgcgctcggcacgctgctgacattgctgttcaatccggcgtctgtcttcttcaaaacgcaaaatcaaatgctcagcttttccgacacgttcagcctgtttctgctgtttcccgatttccgttacattgagatcgtcaaagccgtttgtatctgtatgttaatccttgtcgtcattggctggcggccccgcctcaccggtttttttcactggtggatttcgtacagcttccaaaactccgccgttactcttgacgggggagatcaagtggctgccgtttttacgttgctgctgctcccgctgacattaaccgatccgcggaaatggcactggtctccgtacgaggcgtcttttgagaaaaggccgcttgagccttattaccgctccttgtgctgggcgacgctgacaatcatcagaatacaggtcgcaatgctgtattttaactccgtcattgccaaactgatggaagaagagtggcagaacggaactgccgtttattactatttgaacgatccgatgctgggtctgccggatgcgcttcacggtctgtttgactttatcctgcagtccaagcttgtcatcatcccgacttggggcacgcttattgtgcaaaccattatgttctgcgctttgttcgctccgaaaacatattggcgtctgatattgtttatctccatttttatgcacgaaatctttgccgttatgctggggcttacctcgttttccattacggtggctggtattttggtcctgtttttggtgccggcagagaaaacagtagctttgaaccattacaatcccctttttatcagatacaattttttcaataaaaggaaaaggaggaaattatttggttaaaagcaagaagtccgcagctgccatgatgctggtgtttgttttaatggtcgcattagtcggcccgcatgccgcggcgaaaactgagccgtcggtctcttattcgggtgaagacattttttccggcatctttttcggacaaggtgaggtcgcaaagctccttcctgaagtatgggataccaaggctgtcaaaaagattgatcaggatgaattaaagcaagtttccgatcaggtgatcgctgatattaaaaagtcatcgccggattattttaaagagttgaaagcggcggtctacagcggcgattatgagaaagtgaacagcgtcattgatcaaggttcgcagattatggcgaaagtgctgaaagaagagtttgacaaaaagagcatggacaaaggaaaatcaacggccatcggccaatgcgcaacggctgtatgggtatttttaaacgcggcggccgccattgagacgatcgctcttgcggtagcggccatcattttgacagtagcaagcgttgacgaagattccgacttaggaaaagagcagctcatcgctaatgtcgttgaccgcattaacgcgcagcactgaggctgaagaaagaaaacgctaaggaaacgaaccttagcgtttttttgattgaagcatctgttttaaatatgcttctgaatcaaagccgagttcctcgtcggcttcttttttcagttcaagctgaagtcgcacgtacgtgtcatatttcgggctgagcttttgaagaagattgctgaaaggcgatcccgccttcagcgcgggcagatcagaagcggattctccgaccttgatcaggctttccctgtattcttcatctgtctgcactcttttcacaagctgaatgatgatgtttttatgagtgtcccaagtggcggggtctctctccaaaatccgctcgataaattggtcatgctgtactttgtgctgctggagctgagccggatcctccttgccgaccagctgcatcatcgggtgtgcagccggaacttcttccatatcatccaatactttaataagctccgcccatatcgtttttttctcatctgtatcaatagaaaagtcgaggaacggttcaaacagcgcggcgataaattctccgaaatctcccgggaacagttttttcagctgaagtcccatatacttcggttcatctattttgacctcgccgatatcatgcagaattgaatcgacattttccgcatcttccacgcgcttgatcagcatttcagtcagtttccgttcctgctcaagctcttcaatctgccggctgagcttttgatgctgccggcgcagtatatcatgcagactgctgccctctaagaggaacgctttaatatcgcttacagacagtgccagcattcggagggcggcaatcattttcagcgtattcacgttctgagcggaatactcacggtatccgttatcagggtttttgctgacggtgattaaaccttcctgctcataatatttgatggcttttttcgtgagacccgtctgcctggcggcttcttttatattcattctgaatcactccctgtttttcattctaaacgtgtctctaagggtcaggtcaagagagggcgggaaataagacgggtttattttatattttagaaatttcagaaaatatgattgacaacgcacctttgttgcgattaatataacgttatataatgttatataacgttatataataaaacactgaggagtgaaggatttgagtcaaactgccgcacaagtgaatcacaaagttcaggctttcttggatgatctgaaaggaaaaacgattgaccacgtctttttcgtcgcttgcgggggttcttcagccattatgtatccgagcaagtacgtgtttgacagagaggcgaaagccatcagctctgatctctacagttcaaatgaatttattcagcgcaatcccgttcagctcggagagaactctctcgtgattttatgttctcagtcaggcaatacgccggaaacggtgaaagccgccggtttcgccagaaaaaaaggcgcgcttacgattgcgatgacctttgagcctgattcgccgctagcgaaagaagccgaatatgtcgcggtgtatgactggggtgagaatgcacaggcgataaatacgaattacggggttctgtatcaaatcgtgttcggcgctttacacgtgctggaaaaccatcccgcgtttgagtcggcgatcgacggactcaataagctccagaccgtatatgacaaagcgcttaaacaagaagcggatcacgcaaaggcattcgcgaaagcccacgaaaaagaagatatcatttacacgatggcaagcggtgcgaactacggcgtcgcttactcctacagcatctgcattctcatggaaatgcaatggattcattcccacgccattcatgccggagaatattttcacggaccgttcgaaatcattgatgaatccgttccatttattatcctgctcggcttagacgaaacaagaccccttgaagagcgggcgctttccttctcaaaaagatacggcaaaaaactgactgtgcttgatgcggcagcatatgatttttccggaattgacgattctgtaaaaggctatctggctcctctcgtattaaaccgggtgctcagaagctatgcggatgcgctggcggaagcaaggaaccatccgttaagccagcggcgttacatgtggaaagtcgaatattaagaacgcgcattatatttcaccggactataatgatatataacgttatagtccggtgacaaaggaggaaaagcatctgaaaaagctcatctgcctgttcgttctgttagccgtatgtctgtcagccgccgcctgttcaagccaaagcagttcctctgacggaaaagtgactctgaagttttttcacaggtggccgaaggagccggaaaaaagctattttgaagaagcggtcaaagaatttgaagccgctcatccggatattcatatccaaacggaagcggtcttaaacgattcttataaagacaaggtgaaagtcatgctcggaacaacgagcccccctgatattttcttttcatggagcgaccggtttgcttataaattcatcaaaggagataaagccctcgatctgtcgtcttactatcagcaggataaagattggtcctcacagcttgtgcagtcacaaatcaaaccttttacgcatgacggaaaacagtacggtgttccgtggcaaatggacgctaaatcattcttttataataaggacatttttaattcattacatttgaagcccccggcgacatgggatgaactgatcacagtctctgagaaattgaaagagaacggatatattccgatcagtttcggcacaaaagcgccttggaccatttctcattatatcgggacgctgaaccagcgtatggtggatgaaaaaacgcgggcgaaggattacagcccggaaaccggggagtttacggacgaaggctatgtcaaagcgcttgaaaagcttcaggaacttctgccgtactttacaaagcacgtgaactccgttgatcacgaatacgtgcgccagcagtttacgagcggcaaagcggcgatgatttatgcggaaacggcagaaattaagctcgtcgaaccggtcaatctgggcttgtttcctttcccgaaaatcagcggcgaaaagggatctccccgtgcactgaccggatctccggaaggatttatgatttcctcaaaaacgaagcacccgaaagaagccatggaatttcttcagtttttaacctcgaaaaaaatgggagagaagctgataaaagacgtcggtaaatacagcgcggttcagggaacggcgacagaaaacaattccaccccgatccagcgtgaagccgtgcaggatatcgtccgcgccgaaacaatggtgccgtggtttgatatggatgttgacgttgaaatcgccgatgtgtatgcggcaggcgttcagcagatgctcggcggcacaatgacaccgcgcgaggtgatgaattccgtgcagaaagcggcgcgtcaagtcaaagcgtcatctgaatagaacagatttctttggagaaaggagatgaggatttccttggtcagccgaaaacgtttcattccgtatctgtttctcgcgcccgcgctgatttttctgctgttcgtttacattccgattattgagaatgtgtttttcagtctgtttgaatggagctcatttcaacccgaaaagacgtttatcggtttgaaaaattatattgacctgtttcacgatcccgtattttttacagcgctccgcaacaatgtgctgtatgcggtcatatcgctgatttgccaggttggcggcggcttaattctggcggccgtgctggaagacagattggtaagaaaatggtcgccgtttttccgcacggtcttttttcttccggtcgtcatttccatgaccgtcattgcgctgttgtttgattttatttataacccggaaatcgggcttttgaatcagctgctggaagccgtcggacttgatgaactgacccgggcgtggctgggcgatgaaaacaccgctatgctgtctgtcatttttgtgtctcaatggcagtctgtcggttacatcgccatgctgtacattgtctcgattcagagcattcctgctgaattatatgaatcggcgcagctggacggagccggaaaaatccagcagttttttcacattacggtgccgcagacgaaagaaatgtcgtttgttgctgtggtgatgacgctgaccggcgcatttaccgtatttaatgaaccgtatattctgaccggcggaggtccgggcaatgcttcagaagtgctgagcacatttttgtataagagcgcttttacaaaggatatgatgggctacgcttctgcgatcgcgacggtggtgcttttgctgacgcttgctctgtcgcttattcagatgaaattctttaagaccggaaaggaggagtagccgatgcttcctgaaaagacggacttgcgtcatgcccgtcaggccgtcagaacaggcggaaaaccgagaaaatggtatgtcggggaaacgtctgtgtggctgtttctctttatctacctcattgccgttgcttatccgctgttatggatggcggtcagcgcctttaaaagctcggatgagatttttgagcacagctggtcgctgccctctgtctggcatcccgaaaacttcgtatccgcatggaaccaagggatttccgcttattttatgaacagtgtcattgtgaccgtgctgacttgtctcatcaccgtatttgtgagcgcctgggcggcatacgggctggcccgttttcaatttaaaggaaaagggtttgtgctgatcatttgtcttggcggcttgatgctgacgccgcaggtcagtcttgtgccgctgtactccattatccagtcattgggactgtacaatacgtattgggcattgattcttccgtacgccgcctaccgtattccgtttaccgtgattctgatccgttcctattttttgtcgatctccaaagagcttgaggaagctgcctatctggatggatgtacaagtttcggaatatttttcagaatattcttacctatgagcgtgccgattctggtgacatcaggcattttgacggcttaccatacatggaatgagtttatgtttgcgattatttttatcgatgatgaaaatttacggacgattccggccgggctgatgcagttcagagatgcgctgcagacggattggggcgtgctgctggccgggctgacgatttctgctgctccgatcatcgcgctgtttctattgatgcagagatattttatccgcggcattgctgcgggaagcgtgaaaggataaggaggatgaaaagatgaaactgatagcggccggagataatgtagtagattattatcaggatcaggagacgttttacccgggcggaaatgcgttaaacgtagccgtgcttgcccggcgcttaggccacgaaacttcttatatcgggattctcggcagtgatgaagcggcggatcacgtattgaatgtgctgaaactggaaaaggtgaatgccgatctgatccgccgggcatacggagaaaacgggatggcggtcgtcacgcttgatgaaagaggggacaggatatttgccggatcaaataaaggcggcgtgcaatcgcgtctgacgctcgcttttcaggagaatgacatctcatttatcgccggacatgatctgctgcatacgagcgtatacagcaggatagaacgtgacctcccgatgctgagcggccatgtgccgatttcctttgacttctctgtaaaacgtgacgaagcctatttagaagcggtctgtccgtacgtgacgtatgcgtttttttccgggagtgatttgagtgaaagtgaatgtatgcggcttgccgaaaaagcccgcggtttcggagcgaaaatcgtctgtctgacaaggggggaatatggcgcggtgttatcggatggggaacgcgtctatcatcagccggtggtaagagctgatataatagatacattgggcgcgggtgattcttttatcgccgggtttcttaccgatttcttcgagcatcaggatattcggcgagcgcttactgcggccgccgggacggctgccaaaacatgcggagggttcggagcgttcggttacgggcatccctacaggccgggcggcgggaaaagcagtgaaaaaacgagaatacgataagcattgtctcgttttttatacttgttacgcatagggactgttaatggtaaacgtaacgcggtcggtatgcattaaaaacagcgagctgtatatcggcttgtcttttgacataaatgcggttttgtcaatttcaaaaagcgcatccccgatatcacaagccagatagcggctttcttcctgcttggcgtatacgacatttaacagcttcgtattatgggtgggcaccacctgatagtgctgtttcaaaatgtcatgcatcgacacgccgcctttaatatgcttgccgatgtcgggaaataaactgagcggatagtgggcgatttcgaatgagagcggctggtcgtcgtgaaataaaatgcgttttaattcaagaacgggactttcggaagcgacgcgaagtttttgggcgatggatttaggcgcttcaatggtttcatgggaaaggatctggtgtttcggttttttccccgttgattccataaattctgagtagccgttgaccgcgatgagctcccgcttcagtttagggcttttaacgaacgttccctttccctgctgccggacgagccagccttcttccacaagatcaaggatggccttcctgaccgttatgcggctgacgttgtacgtttcgcacagctcattttcggtcggcagttttacggacggcgaataaacgcccttcttgatatcgtccgcgataatttgtttcagctgaatatataaaggtttcgagctcccgttatttaacaatgggacggacctcctttgtcaagtagtagtactattatatgtattatgacgttataatacaaatttgcttttcatttatgaatctgtcagaaaccccgaacatttttaacataacagaaagatgtggcggtttccagtattggaggaggtttcgaatggcatcattaacatttgaccatatcaaaaaaacatacggcgcccaatcggcggcagtgaaggattttcacttagatgtaaaagatgaggagctgctggtgctagtcggtccctccggctgcggcaaatctacgacactcagaatgattgccggactggagagcatttctgaagggaagctttatatcgatggagacgcggtgaacgatctgcccccgaaggatcgcgatatcgcgatggtttttcagaattacgcgctgtatccccacatgacggtgtttgataatatggcgttcggtttgaagctcagaaagctgccgaaaaaagaaatcgcagagcgagtccggacggccgctgatattttggaaatcgggcatctgctcaagcggaaaccgaaggctctttcaggcggacagcggcagcgggttgcgctcggccggtcgatcgtgcgggagccgaaagtgtttctgatggacgagccgctttccaacttagatgcgaaattgcgagtgacgatgcgcgccgaaatcagcaagctccatcagcgtttgaaagcgaccatcgtttatgtgacgcatgatcagacggaagcgatgacaatgggcgaccggattgtcgtgatgaatgaaggagatattcagcaggccgcaagcccccatgagatttatcattatccggcgaatctgtttgtggcgggttttatgggttctccgagtatgaattttataaaaggcgcccttgaagaaagtcacgggcaatggtattttgccggttcgtccgttcgtctgcccattccgaaagaaaaagcggccgttcttgtgcagaaaggatacagcggtaaggagatgattgcggggctgcgtccggagcatttgacgcttgccggacaatcagagcacccgcctgaagcggtgtgccgcgctgtggcggaagtatgtgaaaacttaggcgcggagatgtacgttcatgcggtgaacggagatgaccgcatgacgatccgtcttgacggcgcttcacaggtgaaacccggcgatgccattctgcttgcggtcaatatgaaccgggccgtcttttttgatgccgacactgaaaacgccgtatattgaaaaagggagcctgatgatcggggctcccttatcacttcttatgatacgattaccagatttcgtccgcccattccggatggtcgataaacggattgcggttatgctgatagtcttcgtaaatgatttcgttccgccgtttttccttactgtcgacggggtcttgttgattccatttgagcaaaacggacagttttcccatgtaaggagctgagccgtttccggttttatcattcagctcaaggtcgggatacccgtcttctccttcataacgcaccgccatgtaaaacagcatgcgggcgacgtctcctttaacctcatcgcgcggctcccaggaatcgccgtcgtaataattgcccggcgctttcgggtattctgagccgccgttatcaaaatccatatttcctctggcactgttcacctgaacgtctgcagggcgcagatgatgaatgtccgtcccggggccggcagctgttccgaagtttccgtgtgactttgcccacacgtgttcgcggttccagtccccggcgctgccgccgtttttacttttggcccgtgattcctgggtgtagagcaagatgacattgttcgggtttgccggatcttcgtcagtttccttcaatgcattccatacttggctgtaagacagctttgtatgtccgctgatgatgcggtgcagggcgctctttaaggccgttccgctttttccggaagcttctttgtaatatgtgtccgtatccgcagacggagtgatgacagctgaggcagtttgcggaaaaagagttgtgtcgccggcagttgaaaccgccatccggctgtacagattcgtgtcagccggcgcgcccgcagaggctgacggcgcggcccatccaaaaatgaaaaacaggcagacaatcggcagaaaccaaagtttttttgtcatgacttgccctcctttacctctattatctgaaaaataaatctactattctatcttttttgaaaaatggttccttcggcttattggtcaaagtatccggaaaatcattgattttttggaagataagataatgaactcgttatgcgctccttctataatgaagatcatcttgtcagtttttcagtttaaaaggagggcgtgtatggaacatcagcagctttcggcggcgaatatcgggatttccgatgacatacaatggctgtctcaattcggcgcttccgcttccggcggagtgacgaggcttttatatacgaaagaatggatggacgcccagcttgccgtcaaaaagaaaatggaggcgttcgggctggaaacggcatttgacgatgtcggaaacgtgttcggccggctgaacggcacagaatcgcctgatgaggtgattctgaccgggtcgcatattgacaccgttattgacggcggcaaatatgacggtgcgttcggcgtgctggcgggcatgctggcgatccgtcatttgcatgagacgtgcgggcgtccgaaaaaaacgctggaggctgtgtcgctctgtgaagaggaagggagccgttttcccatcacctattggggctccggcaatatcaccggtgctttcacgctttcaaatgcggaaacgccgaaagacgcgtctggcatttctctgaaagaagccatgcggcagaacggcttcggtgcaggccgttatccagcaccgctgcgcaccgatattagtgcctttctggaaattcatattgaacaggggcaaacgcttgaacgatcgggaaaggatatcgggattgtcaccgggattgccggacagagacgctataccgttacgcttgacggtgaatgcaaccatgccggcaccacttcaatgaaatggcggaaagacccgctcgcggcgggaagcagcatcatccacgaactgatgctttcagcggaaagacagccggaagagctccgtctgacgtgcgggaaaatgacggttgaaccgaatatggcgaatgtcattccgggccgtatccagttttccgttgatattcgccaccggcaggaagacgtgctggcagccttccatcagaaactggcgtcgattgttgaaaacatcagccgcagcaaaggagtcaggcccattattgatgaatatatgaggatagagccggttcaaatgaatcagacactgacgcgtaccgcagcggaggctgcaaaagaactgggggcggacccggagaaaatcgtaagcggagcgggacatgacgcccagatgctcggcagaacctttccggcctgcatgctgtttgtaccgagccgtggcgggatcagccactcgccgcttgaattcacacccgtacatcagcttgaaaccggcgtccttacgctggcgaatgtattacataaacttgcctattaacgtaaagggggaatcggcgtgccgaccagaaaagaattgtgcattccgcaaagaacgattatgacaccgggaccgacagaagctgaaccgagagtgctgagggcgatgggcgctccgatcatcggccagtttgacccggcatttaccggcatcatgaacgaaacgatgcaaatgctccgtgaattgtttcaaacggaaaaccgctgggcctatccgattgacggtacatcaagagcggggattgaggctgttctcgcaagtgtgatagagccgggcgacagcgtgctcgttccgatatacggacgcttcggatacctgctgactgaaatcgccgagcggtacggagcggacgttcatacgatcgagtgtgaatggggaacggtcttccggcctgaagagattatcagcgagatgaaaaagatttccccgaaaatcgtcgctatggtgcacggagaaacatcaacggggcggattcacccgctgaaagaaatcggggaagcgtgccgcgcccaagacgcactctttatcgtggatgccgtggccacgattggcggatgcgccgtaaaaacggatgaatggaagattgacgcagtcatcgggggaacgcaaaaatgcctatcggtcccttccggaatggcgccgattacttataatgaccggacggcagctgtcattgccgcgcgtaaaaaggtagaacggggcattgcgacggcagctgacggcaaaaggctgtccggtcatcggccggttatgagcaactattttgatctgagccagctcgaagattattggagtgaaagaaggctgaatcaccatacagaagcgacagcaatgctttatgcgctgcgggagggtgtgcgccttgtcctggaagaaggacttgaagaacggttccgcaggcatcggcgtcatgaaaaagcgcttacggcgggacttgcagcgatgggccttgatttattcggcgatccggaggcgaagctgcctgtcgtcacatgcgtgaagattccgccggaagcagacggcgaatcgatcagaaggatgcttttgtctcaattcggaattgaaatcgccagctcgttcggtccgctgcaggggaaaatttggcgaatcggaacgatgggctacagctgcagaaaggaaaatgtgctgtttgtgctggctggacttgaagcggttctgatcagacacggagtttcagttaaagccggggaagcgctgcaggcgacccttaacatatatgatctgccggctgaaaccgttgtgcggtcatgagacatgaaaacgagattgaaatcatctggacttttttcccttttccccgttatactgaatggtataaaaaatgacaaatatggaatgatcatctgtttgtctggggagaaggtaagaaatcatggcgtacatgggccgattgtcaattttaatgctgaatatgtttattgcgatgcttggaatcggattgattattccgattatgcccgcatatattaccgaattcggagcgacggggagcacgatgggtctgcttgttgcatcggcggggcttacacagcttttatttgcgcctattgccggggaaataaccgacaaatacggacggcggaaactgattattttcggcattgccgcctttgccgtgtcacaattgatcttcgcttttgcaggaagcctgtggcaattgttcgcatcccgccttttgggcggaatgggcgcggcgtttttaatgccgtcaatgttcgcttacattgcggatattacgaccgaggaagaacgcgggaaaggaatggggctgttcagcgcggcgatgacgctcggtgtcgtcatcggacccggtgtcggaggctatttggttcattacggcatgtctgtgccgttcatcgtgtccgcaagtctcgcctgcttttcaacggtgctttcatttttctttctgcccgaaacgctgggacgtgaaaagcagctggaagcccgggcaaaaacggaaaaacgtgagcatctgtttaagcaaatgtcacgcgcgctcaaatcgccgttcgcgtttatgctgattctggtttttgtgctgaacttcggaattatgaactttgaatccgttttcggcctttacgttgaccataaacacggatttaaagcgtctgatattgcctttattattacggctgcgggtctcatcggcgtgtttgtgcaggcggtcggcgtcagttatctcgtccgcaggttcggggaaaaacgcgtcattaacgtgacgttgatcggggctgctgcaggacttgtgtggtgccggtttgcgggttcatattgggccgtttttgccgcggcaatctttttcctgacgctgacatcgctgctccggccggcggttaatacgatgctgtcgaagctcgccggtgaccagcaggggtttgccggagggatgaacacctcattcatcagcttagcgaatatcgccggaccgtcagccgccggttttctctttgatgtaaatatggaatttccgtatatgctgggagcggccattctcgccatcagttttctggccgcgcttggctggggcaaaaagacacagacccggccgttcacgcagcaaggatagaatcaaaagcctccgggtatccggaggctttttgctgattgccgtttattctttggctctgcatctctgaaattgcagagatgcgcatagaaggaaaatcatatcgaacgccattgtgaattatagggaaatcagttgttccatatgctcaagcgcgaatggaaaccggaacaggtgtagataaaggaaaaccagctttatcgcttgacgagtctgacgaatttgatgccggaagttgatcaaaaaagaaggcagtcaggcggggacatcattgagcggaaaatgctgagaaggaaaaagcagtggtttggaacttgctgtttcgtatgcagagggagagcattctgataaaacgggtcattgaaataatacgaactgttcagatggggtctattggtgtattacggagtggcggtcttataaaacctctctcgggtgattttgtgatggttcccctgcacgaattttgcaggctaaaacccgcaattaggccaacacacaattatgcaagagacaatcatctaaaaagggtgtcggtaagtacaatatggtgtacggaaaaggagttgaaaatgttgtattattacccgtcattccatttgtatcagcggcaagaatttaattcttatccatgggcccatcaattgacccattcagggagctccacctatgtttccgcgcgccctcctttttataattctccatgttacagagagtgcataagaagcggagcggatagttatttctgctgctatatctgcggtttttgttaaaaagaaagacttatagaagtaagtgatctttccaagatgacagtgagaccattatccagacagccattagccaacatacgaagcttcattacgattcacggaggggaagcgcccctccttttttggaaattttataaaatccccttgcacggcccgtcagaagtggtatttggtcttgatgtgttcgactgttggtattgacaaagaattcaagataccaggaagcagcgaaacttgtatgtatcagcgagacacaaagttttccgccgctgagcgggttagttctcactgcgttctatctcctgtagtagataacgagattttggggctgtctgctgaagaaaaagaagagattcgcagtgaagtcttagcaaacatggaataaaatagtataatatcctcattacttttacgaaatgagggaagttatggattggttggagttttggtcatcagtaataaaatctattgcctggcctattattgttttgatagcagtgttttttttgagaaagcccgttactcaattaattgaaaaaatagctgaatggaagctagctacacttaaatatggagattttgaagcaacatttagtcaaggtcttcaaaaagtcgagtcagagttagatgagtctgatactagcggcagttctgagcctgacgattctcaaacaaataaagagccttctttaattcagatactaatatcaatatgatagctagagaagctccttacttagcagttgtcctatcttgggttttggttgagcatgaactagacgctgctatggcaagagtaggttttgatagtgatacacttaaggggaaatttgtaactgcaaaattaaaaatgaggtaccttattgaaaataaatatttagacaagagttattatgatgcttttagtgacctgttacgtttaaaaaacgtagcttcacacgaatataaagaagctaaaaacattagttactatgattctatgaaatataacaaattaacaaaaaaaataatcaaagggctcaaagatatagctcctttttaaagatcttctatcatgaaggtctttttattttgaaatgagtgaacacatgccaagagaactgataaatgcaaaaatcacacatgtttcttacgtagacaaggctgctaatcaaaagcagttttttttatgaaatcagaaaaagaaaagcagcatgactttcagggcggcgttggtgaagtggttgagtcttatgtcgctccccgctgatttttaaatgaatggcgaaaccatcaaaaaaggatcatgggtgcttgtgacaaaggtaccgaggcaatttgggaggaaattaaaaagagtgagattatcggttgtatcctgaatatcgaaaaagcctgatgatatcaacggaagcagatgttgatggcagcattttttgagaatttagctgaatgaattccccttaaataggatgcgggagaacaccccgcatccctgtctctaacgatttcttaaccgatcagccgctgcattctcagcgcgagccgcaggcgcatcgtcgtctccggatcttttaagcttttgccgagcagttcctcgcatttttctaaacgatagatcaccgtatttcgatggacgtacaggcgcttagccgtttctgaaatctggcagtgggtctccagataaacagacagcgtatgaagcaggctctggtcctccttttgccggtcggccaggctttggagggtggcttcgtaaaatttcttcacatcttccgccggaagcaggcggagaagctccggcacgtctttggcatgatagatttgaataaactccgcgcttctggacaaatgcccggatgaaatggcgtctgaagcttcagtaaaagcgtcagggacgtcgatcagcttttggcatatgtttgagatgccgaaggagacagtccgtttaaattgcgtccggacctgcttttgaaactgctccaaaaagctgatgacagacgcgtgcatttcattccagctgtctgtcgcttcaattaaaagaataccgacatttcctttaataaagagatgagggggaaacgggaaggatgacagctccccttcaagcagatcaaatacatgatcggaaacgagctgattttcggtaaagctgatcgttttctcatttcggtcaagctttccgcaaatgcacatgtatttctgatcccagcggagccggaattctttggcgcggcttttgatttcttcatggccggtaaacgagcggtcgatgaaattgctgaaaaattcattgcgcgcccgtctgctgaattgtttgacggcattttctttcagcagttcaaaggaaatgacgttagccgcctgttcaatagtcaaaatcatgcctttatcagcggtctgcaccagctccggtatcaccagataaccgcagtttttttcaacattcagaatcggcaggacagaatacgcctttctgtcggacagcatggaaaagcaggtgaaataaggcccggaaagggaataacagatgtttttcaataaagacgtgtcaatgggtatgcggtgggacgatgataagagttttgtatgctgatccaaaagcagcacgggaagccggagaatgtctgagagcttcttaagcagggattgcagccccttgccgctcatgatgtggtttgtgaattttttatgggcgtaaatggcctgctggagctcatttgaacgcatatcaagaatatggctcagtgtggcgttgacgatatctcccagcctgatgtcttccggcagctcaataatcggaaattcataccggtcggcaagctccgcggcatctttcggaatgacattaagataacgcttcgttttgatccccagtcccgcgcagccccgttttgccatgaggcggatcaaatctttcaacagttgcgggcggtccttcaagtggtaagccgtggtgacgagcaattcgtttttatgtaaaaaatcagcgatgtccggcgcatccatcatgttgacgtgctgcacctccctccagccgccggatttgcctgcgattaatgcagcccgctcataagcgggaatcttcatcacgtcataaatgttcatcagtcagtctcctttcaggttctaaagacaaccattggttaatatgaataaaaatcatcaaaaattatagcggttttgctgatgtattacgatcatagtagcagtaaactggcaatcatagacgcatgttgtgataaaaactgacagaaaatcgtcatccttacagggaggaagataaaatggcctatgacgtaattgtaaagggtgcgaaagctgtacgaaaaggcggaacagagcgggctgatatcgccgtcaaggacgggaaaatcgccttgatcggacccggcattgacgaaaacgcggaacaagtggtgcaggcggacggcatgtatgtgtttccgggcgcggtcgattgtcacgtccatttcaatgaacccggccgagaagaatgggaaggcattgaaaccggctcaaacatgctggctgccggcggctgtacggcttattttgatatgccgcttaactgcatcccttcgacggtaactgctgaaaacctgctggcaaaggcggaaatcgccgaacggaagtcagcggttgattttgcgctttggggcggtttgatgcccggatataccgaacatatccggccgatggcagaagcgggggcaatcgggtttaaagcgtttctgtctaaatcgggaacggatgaatttcaatcagccgatgaacggactcttttaaagggaatgaaggaaatcgcggcgtgcggcaagattttggccctgcacgcagaaagcgacgccctcacccgattccttgaagccgagtacgcgctccaagggaaaattgatgcccgcgcttacgcttcctcccgtccggaagaggccgaatgcgaggctgtgcagcgggcgattgaatatgcaagagcgacgggatgcgcgcttcattttgtacatatcagcacgaaacgggccgtgctctccattcagcaggcgaaaaaagacggattggatgtcaccgttgaaacgtgtccgcactacttattattcagctttgaagacttcctcaaaaaaggggcggccgccaaatgcgctccgccgctccgctcagaggctgataaagaggaaatgatcgggggtttggctgagggcctgattgatatggtgtcttcggatcattctccctgtcatccgtctttgaaacgcgaggataatatgtttctgtcgtggggcgggatcagcggaggccaatttacgcttctcggcatgattcaattagcgatcgatcatgggattccgtttgaacatgtggcccgatggacggccgaagcaccggccaagcgcttcgggttaacgaataaaggtcggcttgaagaaggatttgacgctgattttgccatcgtccggccggaaccttttaccgtcacaaaagaaacgatgttttccaaacataagcaaagcctgtatgaaggccacacctttccataccgaattgctgcaacctacagtaagggacgctgtgtgtatcaggatggcggtcgtaagcagagcggggctttcggaacattcctgaagccttctcaaataaaagagccgattctctgatgagaatcggctttttttgtcgtttggaaagcgggtctcgtggtatctttttataaaaaggagtaaaacacattgtatgatcaaatcttgaacatattaacggcatcctggtcgcgcaagactagtacaaaatggacggaagattgcccggccaaaggccagtgcggcgtaacggctttagtcatccaagatgtttacggcggtgacattctcaaaacaaaaaccggcacaagctggcatttttataaccgaatagacggggagatatatgatttcacgagcggtcagttttcagagccgatcgtctatcagcacattctttcttccagagatgaggcattttcggacaccaatgaacatcagtaccggttcctgaaaagtgcattcagaaaaaacatggaaaaagaaagagaaaaacacctgtgataaactagagtgagaggtgaaggattgtgatttatatcggactgacggggtggggggatcatgacagcatctatccgcctaaaacagcgggcccgcaaaaactgcaggcgtattcctcccattttcccatcgttgagctggacgcgagcttttacgcgatacagcccgcccgcaataatgaaagatgggtcaaagagacgccggaatcttttcaatttgtcattaaggcatatcaaggaatgacgggtcatcagcgcggcgatattccctttgaatcgaaggaagaaatgtttgaggcgtttaagctgtcattatcgccgtatatagagcatggaaagcttgccatggtgctgttccaattcccgccgtggtttgactgcaagaaagaaaacgtcgcatatttaagatggtgcaggcagcagatgggcgatatcccgtgcgcgcttgaattccgcaaccggtcttggttttctccgccattttacgaacagacgctttcctttatgaaggaggaaggctggattcacagcatatgtgacgagccgcaaatcggcgagggcagcattccgaccgtcctgaaagcaacggatgaagaaaaaacgcttgtccgttttcacgggcggaacaaacagggctggatcaaacctgacggcggacaaaattggcgtgaggtcagatatttataccgctataacaaacaggagctcaaagattggaaaaacaatcttcaggagctgaaaaaacagtcgcgcaatctgtatgtgctcttcaataataactcaggcggagacgccgccgataacgggcttgagatgcttgaaatgttaaatatctcatataccggacttgctccgaagcagctcgacctattcagctagaaaagaggtttcaagacacatgtcttatcttattttgattatattgggatttatcgcgggaacggtcggcagcctgatcgggcttgggggaggaattatcatcgtgccggcaatgctctatttaagcacgatgactccgtttttccatgacgtaacaccgcagactgccatcggcacgtcccttttggtgattatttttacgggcctgtcatcaactctggcctatatgaaatataaaaccgttgactacaaaagcggactgatcttttttatcggttccggcccgggaagcatcatcggcgcgtatttgtctaaactttttaatgcgcatacgttttccgtctggttcggactttttatgattttgatttccattacattaatgctgaaggcgaaagcaaaaccggtcaataaagcgcataaaggcatgatccggacatatgaggatgaatcgggtgagctttatacatattcgtaccgtatttttaccggtatcgtgattgcctttttcgtcggtttattgggcggtcttttcggcattggcggcggctctcttatggttccggccatgatgctgttatttttgttcccgccgaaagtggctgtggcgacgtcaatgctcattattttcttatcctccgtgacgggttccgtgtcacatatcgcagagggccatgtcaattggctgtatgcgctgtgcctcgttccgggcgcgtggttcggcggcaaaatgggcgcgtgggttaataagcgggtgcagacgaaaacgatcgtgcttttcatgcgggtcgtcttgattttgatcggctgtgaattgatttatcaagggatattcagctaaaaggtaggagagatggtatgttagagaagctccgtttatatcatacgaatgatttgcacagccatttcgaaaattggccgaaaatcgtacattatattgagcagaagagaaatgaacatgaaaaagacggggaggaaacactcgtattcgacatcggcgatcatatggaccgattccaaatgataacggaagcgaccttcggcaaagcgaatgtcgacttgttaaaccggcttgagatcgatgcggctgccgtcgggaataatgaaggaattacgctgcctcacgatgagctggcggatttatatacccatgccgcgtttcccgtcattgtgtccaacctgtttgacgcggatggacagcggccggaatgggccgagccctacgtgatcaaaacactgaaaaacgggatgaccgccggcatactcggcgtcacggtgccgtattatcccgtctatcaaaaactcggctggacggtgacggatgcggaaaaaagcattcaagaatcacttgacgatatcaagggcaaagcggacatcatcattctgctttctcatttaggcctgatcgatgaccgggccgcagcggaaaaatttccggacatcgatgtcattcttgaatcacatacgcaccaccttcttgaggacggacaggacataaacggcgtattgcttgcatgtgcggagaaatacgggaactatgtcggctgtgtcgagctgacgatagaaagtgaatcacgaaccattgtcagcaaacaggcgtctgtacagaaaatggctgattggcaaggggaatctgaagatacggcggcttttctgaaagagaaggaacgggaagcggaaaacctgctctccgaacaagtcgccaacctgaatgaagaagccggcgtgaagtggtttgaggaatcgccgctcccgcttctattagccgaagcgctgaaaagctggtgcggctgtgaagtcagcatggtgaattcaggcgtcattttggggcctttacagaaggggcctgtcacaaaacttgacctgcaccgcatctgccctcatccgatcaatccggtcgccgtgcgtctttcaggcagggaactccaggaaacaatcagccaggccgcctcggaacaaatggagcagctgcggataaaaggcctcggcttccgcggggaagtgatgggcaggatggtatatgccggagcggaggcagaggccggcatccttgaagacggtgtgacgcatctcctcaatgtgaaagtgaacggagaagagattgatccggagcggatatactcggttgccgttctcgatatgtttacactcggaaagctgttcccttacatccgcgattcaaaagaaaagcaatactttatgccggagtttttaagggatctgctcgcctggaagctcgcgcggcagccgtaatgtcatgtagctgcccgccgttccatttcacccgaatgagtgaaagcgggactttttaagagtgaaaataaaatactatgtcccctcttacaagcatacattgtgatatgtaaggggggatttttcttgcctagataccggagcgctcttcgcaagagagggcctttgccttttcgatatgtgcttcttctgtcgtttgctttttttatcatatcgacggtcatcagcctttggatgatcaactcctcaatcaaaccggtgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagtatgaaggcgaaagtgacaaagcagcttcaggctcatctgaaggaagcggagtcgaacaataagcagcatgaaacggaaaaaggcgcgaaaacggccgatgaaattatgatcgatattcccttagggcaggtcacgggaaacagcattctcggaaatctggggccgaaaatccccgtgcgctttaacctgatcggtgatgcgttaactgatgtgaaaacaaaaataaagccgtacggcattaacaatgccctgatcgatatcagtatttttgtggaaataaaagtgaaggtcattattccgtttgccagtaagacatcagtcgtgacaaataatattccggtctccattaaagcgattcaaggagaggtgccgcagttttataacggaagcggcgggtcaggtgtgacgccttccgtccagctgccgagtgaaaaacagaagaaagataaataaaaacacacagccgcaatctttcctggcggctgtgtgtttactttttcctgcggatttcttttcgttcccatgcccttaaatggggatacggatcaaaagaccattccgatctgccgttatctttatacatcccgtagtgaagatgcggcggaaattttcccgcggtgcccggcggtccgtacccggaactgccgacagagccgatcacctctccgggtttgacgatctggcctttatgcacaccttttgcaaagccgttcaggtgagcgaagtagtgatacgtgttattgatatccctgatgccgattctccagccgccgaaacggttccagcccttcatttcaacaataccgtagcaggtcgatctgacggggagcccgtaatgagcgaacagatccgttccttcgtgaatccggcgcccgccgaaaccccgtgcggcgccccatgtgctgcggtagctgtaatccgtcttcacgggaagcggaaaagcgtgctctccgagatcaaggcggccgaacgttttaaacagtgtcatgaattcggtgataatgccgaccgtctgatcacggcggtaataattccagagaccgatgcggatatggtcaagatcggttccgaatcccgctaaatactgagcaaatgtataaaggatatcctcatcattgcttacctcggcttttccgtcgccgtcgccgtccaggccgatcccgtcaaatactttaatgctgagaggcgcatcgtccttaggatttggattttcagggccgctccacaaatgatccggaatataaatgctgatgattcccgctttttccggcagatcctttcggttcgagcggacattttcttcatattgatcaactgccgcaagcacataccaaggaatctgcgtgactgcttcggctttgcggtacaactgcatccgttcgccgtaaacaagagccgattgttctttcccgcttgcagccggacagaaaactgaaaaaaggagaagagcagataacagaactttcacaacatgatctcctttcaggattgaatacaaatagtttgcggcaacaatccgagaaaatgtaagtaattctcttcccttgtcgagaaatttttcctatgttaaagtgactattgaatagaaatccgcaagttttatatccatcgtgaaatagaaatttttcgcacacgaacatgaataaagggttaatggagatgatggggaaatggcaaagaaagacgagcatctgagaaagccggaatggctcaaaataaagctgaacacgaatgaaaactatacgggtctgaaaaaattaatgcgtgaaaataatctgcataccgtatgtgaagaagcaaaatgcccgaacatccatgaatgctgggctgtcagacgtacggcgacgttcatgattctcggttccgtctgtacgagagcatgccgcttctgcgctgtaaaaacgggactgccgactgagctggatctgcaggaaccggaacgcgtagctgattccgtcgcgctgatgaatttaaaacacgccgtcatcacggccgtagcgcgtgatgatcagaaagacggcggagcaggcgtctttgcggaaacggtccgggcgatccgcagaaaaagtccgttcacgacaattgaagtgctgccatccgatatgggcggaaattacgacaacctgaaaacattaatggatacccgtcctgatattctgaaccacaacattgaaaccgtccgccgcctgacaccgagagtccgggcccgcgcaacatatgaccgttctttggaattcttgcgccgtgcgaaagaaatgcagcctgacatcccgacgaaatcaagcattatgatcggtctcggcgaaacgaaggaagaaattattgaagtgatggacgacctgcttgcgaacaatgtcgacatcatggcgatcggccaatacctgcagccgtcgaaaaaacatttaaaagtccaaaaatattatcatccggacgaatttgccgaactgaaagaaatcgcgatgcaaaaaggcttcagccactgtgaagcaggcccgcttgtccgttcttcctaccatgcggatgaacaagtgaacgaagcgtctaaaaaacgccaggcccaagcataagataagccgaaaaaacccaaaacgccgcaggttttgggttttttgtgatggagccgtttttgcagggaaaaagtcattcttgaataaggatcgtctgaaccgctacactggatataaagaggaaaaattctccgtccgtccgaaccgtctcattttgcaattgatggacagaagtcaatgaattatgatagtaaagagtgataaaagaggtgaagacatgattcttattcaaaatgccgagtttgaactcgtacacgattttaaaaacggctttaatgaagaagcgttcaaagcccgctattcggacatattaaataaatatgattacattgtgggagactggggatacagtcagctgcggctcaaaggcttctttgatgaccagaatcaaaaagcaacctttgaaacgaaaatcagcacattggacgaatacatttacgaatactgcaatttcggctgcgcgtattttgttttaaaacgaatcagaaaataattgatgcagaaggggatgctgtcacgtgtattttgttgacagaaataatatcgaacaaacactccgtttttttgagacccagctggcgctgtttgacagcacgcctgcatgggagagcgagatcgaaaaaagggcgcttgagcggatcagccatcttatgatcgaatgcattctcgatgtcggaaatgatatgattgacggctttatcatgcgcgatccggggagttatgacgacatcatggatattctgacggatgaaaaggtggtagctgaggatgaagggaataagctgaagcaactgatctcttccagaaagcagcttgtccaggaatatcagcacgccgatcatcaggagctgtttacgctgatcacgtcaaacagagatgtgctgaaagcctttccggcccgtgtaagaacctacctggaaacagaattagggcctgtttccgcatttaaataacaacgagtgagaaaatccacaggagtgttgagtatgaaggattataaaggatatttgatagatttggacggcacaatgtacaacgggacggaaaaaatcgaagaagcgtgtgaattcgtgagaacgcttaaagcgcgcggcattccgtatttattcgtgacgaacaattcttcccggacgccgaagcaggtggcggacaagctgatgagctttgacattccggcatctgaagagcaggtcttcacgacgagcatggcgactgcgcagcatatcgcccaggagaaaaaagacgcgtcggtgtatgtgatcggcgaagaaggcatccgtcaggccattgaagaaaacgggctgagcttcggtgaagaaaacgcggactttgtcgttgtgggaatcgaccgcggcattacatatgaaaagttggcaacgggatgccttgcgatcagaaacggcgcccggttcatttcaacaaacggcgacgtcgccattccgactgaaagagggcttttaccagggaacggttcgctcacatccgttttgacggtgtcaacgggcgttgagcctgtctttatcggcaagcctgaatccattattatggaacaggcgatgcgtgtgctcggaacggatatttccgaaacactcatggtcggcgataactatgcaacggatattatggccggcatcaatgcgggcatggatacgctgctggttcataccggagtgacaaagcgtgagcatatggcagattacggccaaaagccgacatatgcgattgactctttaaccgaatggattgaacatctataaaaaagggacggccatgacggccgtccttattctgtatttctggcgctgtgagcaagccggcttgaagccgctgctgcgattgcgccgacgatatcatcaagaaacgtatggcattcgcccgtagatttatcatttaaccgcccgagaataccgggtttttctttgtcaatgtagccgtaattcgtaaagccgattgagccgtatatattcacgatagagaaggcgagcacctcgtcaaccccatacaggctttcatcaatcgccagaatggtctgaagcggttcagacagctttttttgttcggcgagcacatctaattctattcccgttaaaatggcgttttgcacctcgcgttttgcgatgacacggtccacattgagcctgcatacctccatcgtcaaatcaggatgatattttttttgaaggaaatacaccagctcggcaatatcgtccgtctcaaccccccgttcttttaaacgcgccctggcgacagcttccacctgattcagttgttccttttctgacatttgcttcacccaatctttttttactagtttatacaacactcttccgatgtgtacgatgtttctccacttgattcaaaggattacaatatgtattcataattccgccggcgtatgactacgatgtgaatagctctaatttttcaggcaggtgattatgatgaaaagcatcattaaagaaaaatacggcatccacgtcagacagctctccgtttatcagaaataccaatgcttccagacgcctaattccttctttcttataattcccgtttccgggttttcgcaatcagagctgacggagctttactacatgagtcagtatttacaagaacaaagtgacccatacgtttcagtgtttatctttacgaaggaaggagaactgacctttgaggacgaaggcaaaacgtatgcgctcttaaaagcgccgattcccgtctcaaaccggtcgttttctgtcggaggggagcttgccgaatttcacagaaaagggcggggttttccgtacgaagtgaaagaagcgggcaggatcggccaatggaaggacttatggggaaaacgggtggatcagctggaatcattctggatgcagaaaattcatatgtctccgcttgaaccgttcgaaaagaaaatgatcgaagcatttccttattattcaggcttagcggaaaacgccattcaatatttagtggatacggagctggatgacaatcccggcgcagaagactcggggacaatctgccatcagcggatggaacgggatacctggtcggaggaatcattgatccgcattccgggcgattgggtattcgaccatgccgcccgtgatattgcggaatatatgcgcagcacatatttgtatcatcgtgacgacctgctcaaagatgggtttttgtttctgcaggaatatgagcaagttacgccgttatcctccttttccaaacgcctgttttacagccgcctgctgtttccgctccatttcttcgagacggtggagagctattacatttctcatgattctgaaaaacagttttacgaagagcagcttgactacattcttgccgactgcacccgctatgaacagtttttacagacatgtcacaacatgatgaatgtcaggtcggcgcaggtttttgtcccgcctgtggcgtggctcggaaaaggaatcagttcgtaagaaaatatgacgtaaaaatatttagaaaatagggaatcttgtcatatcagtgtgttaagcgttttcatagccgtagaaacaatattcagccgcttgtcaaaacaaatgcgggcttatataatatttgtaacttaaatgtctgtgaagggttaacaattgtccttttctagtggacaaaaggaagaaaggtggagtttctctttggaagcgattcgtattggactgttaggactgggaaccgtgggaagcggagtcgtcaaaattatacaagatcatcaggataagcttatgcaccaggtcggctgtccggtgacaatcaaaaaagtgctagttaaagatattgataaaaaacgagacgcagacctgccgaaagaagtgctgacgacagaagtctatgatgtgatcgatgaccctgaggtcgacgtgattattgaagtcatcggcggtgtcgaacagacgaagcaatatcttcttgatgccttgaaagcgaaaaaacatgttgtgaccgcaaataaagatctgatcgccgtatacgggtcagagcttttagccgccgcaaaggaaaatggctgtgacttgtattatgaagcgagtgtcgccggcggaatcccgattttacgcacgctcgaagaaggcctttcctctgaccggatcacaaaaatgatgggaatcgtcaacggaacgacgaacttcatcttaacgaaaatgattaaagaaaaaagcccgtatgaagaagtgctgaaggaagcgcaggatctcggattcgcggaagcggacccgaccgccgatgtagaaggcctcgatgccgcacgcaagatggcgattttagcccgtctcggcttctctatgaacgtcgatctggacgatgtcaaagtaaaaggaatttcccggattacggatgaagacatcagcttcagcaaacggctcggctatacgatgaagctgatcggcatcgcccagcgtgatgacaataaaatcgaagtcagcgttcagccgacactgctgccggatcatcatccgctctctgcggtgcataacgagtttaatgccgtttacgtgtacggagaagctgtcggcgaaacgatgttttacggccccggagccggaagcatgccgactgcgacatcggtcgtttccgatctggtcgcggtcatgaaaaacatgcgtctcggcgtaaacggaaacagctttgtcgccccgcagtttgaaagaaatctgaagcagccgtctgatatctatgcccagcagtttttaagaattcacgtcaaagaccaggtcggctctttttcaaaaatcacatcggccttctcagagcgcggcgtcagctttgaaaaaattctgcagctgccgatcaaaggccatgacgacctcgcggaaatcgtcatcgtcacgcatcatacatcggaagaagatttcagtgacattctgcaaaacttaaatgacctcgaagtcgtacaagaagtaaaaagcacatatcgcgtagaagggaacggttggagctaatgtggaaaggactcatccatcaatataaagaatttctgccggtgacggatcagacgccggccctgacattgcatgaaggcaacacgccgctgattcacctgccgaaactttccgaaaagctcggaattgaactgcatgtgaaaacagagggcgttaatccgacgggatcctttaaagaccgcggcatggtcatggcggtcgccaaagcgaaagaagaaggcaatgataccatcatgtgcgcctctacagggaacacatccgcggcagctgcggcatacgcggcgagagccggcatgaaatgcatcgtcatcatcccggacggaaaaatcgccttcggaaaacttgcgcaggccgtcatgtacggtgcggaaatcatcgcgattgacggaaactttgacgacgcgctggccatcgtccggtcgatttgcgaaaaatcaccgattgcattagtgaattcagtaaacccttaccggattgaagggcaaaaaacagcggcctttgaagtatgcgaacagctcggcggagcgccggacattctggcgatcccggtaggaaacgccgggaatatcacggcctactggaaagggttcaaagaataccatgagaaaaacggcaccggacttccgaagatgcgcggttttgaggcggaaggttctgcggctatcgttcgcggcgaagtcattaaaaatccagagaccgttgcgacggcaatccgaatcgggaatcctgccagctgggacaaagcggtgctcgctgcggaagaatcagccggaaaaattgatgaagtcacagatgaagaaattcttcacgcttatcagctgattgcccgtgaagaaggcgtgtttgctgaaccgggctcctgtgcatccatcgccggcgttttgaaacaggtgaaatccggtgaaattccaaaaggcagcaaggttgtcgcagttttgaccggaaacggcctgaaagatccgaacacggctgtagacgtatctgacataaaaccgattacgctgccgacagatgaggacagtattctggaatacttaaatggagcggcgcgtgtatgaatgaggcggagatgctgttttccattacggttccgggaagcaccgccaacttagggcctgggtttgattccgtcgggatggcgctcagcagatatttgaagctttcggttttccgaaacgatgaatggcagttctcggcggaaaccgaaactgtcgcgggcatccctcaaggaacggacaacctcatctaccaagtcgccaaacggacggctgaccgctatcagaaagagctgccgcccgcccatgtcaaagtgtggagtgacatcccccttgcacggggtctcggaagcagcgcggccgctatcgtcgccgccattgagcttgcggatgagttatgcggcctgcagctgtcggaaagcgacaagctgcacttagccagtcttgaagagggacaccctgataatgccgctgcttctcttgcaggagggcttgtgatcggccttcacgaagaagatgaaacacatatcgtgcgtgttgccgaagcggatatcgacgttgtggcagtgattccgttttacgaagttctgaccagggacgcaagagacgtgctcccgaaagagctgccgtaccgacgcgccgttaaagcaagcgccgtcagcaaccttctcgttgctgcgatcatgtcaaatgactgggcgctcgccgggaaaatgatgagaaaagacatcctccatcagccgtaccgcgccatgcttgttcctgagctttcaaaggtggaacatgcggccgaaatgaaaggcgcctacgggacggcgctgagcggagcgggaccgacgattcttgtcctgattgaaaaaggaaagggagaagagctgagaaagcagctttctgagcatttcccccactgtgagattgcggcgcttaccgtcccgtcagaaggaagcgtaattgaacggaatcctttagagcaggtgaaaagtgtataatgataaaaaagcgttcttcccatcagagaaggacgctttctttttctggagaaggatttttatttagggaagcgaaataaaaaagaaaaggaggagatacgattgaaaaaactcataaccgaggaggacattgcgactctcgtatccgtgacagacccgcaatatgcccctgacggcagaagagccgcttacgtccggacaacagtcaatcataagcgtgattcctattcctcagccattatggtatatgacacagaatccggcatctcaaacccatggactttcggggacaacagaaatacaagtccgcggtggtcacctgacggacagcgcctcgcctttgtttctgacagggagaacggcgtccctcagctgtacatcatcgacgctgccggcggagaggcaaagcaggcggccgatattccttggggcgtatcagatccgatatgggcgcccgacggcagatccgtgcttgtgtccgtcagtctgacatcagcggagcgcgccgatgagaaagaaaaaaagaagcatgacgagtatgagccggttgatattcagtcattaacatataaacgtgacgggaaaggcctgctgaacggaagctgggcccagcttgtgctgattcatcttgaaacgggggagattcagcagctgaccgatcatgaagcggatcattatggcgcggccttttcaccggatggcaggcagcttgcgtttaccgccaatttatgcgagccgggtgacgccggaaagccgagcgatgtctatctgatgaatctggcggacggaagcctgaagcagattacgccgcaccgcggttctttcggtttctgcgtgttttcaccagacggttcttatatcgcgatgctgggccatgaaaatgaatttcgcaatgcgactttagagaaagcgtggctgtacgacgtgaaaactgagcggctctcctgcctgaccgacatgctggatgttcatttgagcgatgcgctgcttgcggattcaatcataggaggagtgacgcctcggccggtatggacaaacgacgggcagggtttttacgttctcgggagcgagcagggaagcaccggtatttattatatctcgattgacggcctcgtatatccgatccgattagaagaagagtatgtgaatggttttgcttttcatcctgatcagaaaagctgtatcgctgtcattgccaaacccgcacagccttccgagctttacagcatttcgctcgaagatggggaagagaagcaattgacatccgacaatgatcggtttattgaggagcgcatcatatccgtgccggaaaagctgcaatatgaaacaaaggacgggctgacggtaaacggctggtttttaaagcccgccgtttttgaagaggatcaaacttatccgctcattctatacatacacggcgggcctcacatgatgtacggccatacgtattttcacgaattccaagtgctggccgcacaaggatatgctgtcgtgtatgtcaacccgagaggaagccacggctacgggcaggattttgtcaatcgtgtcaggggtgattacggaggcggagattaccgtgatgtcatgcaggcggtggatgaagctgttcaggcgtatccgtttattgacagcggccgtctcggtgtgacgggcggaagctacggagggtttatgacaaattggattgtcgggcagaccggccgttttaaagcagccgtcacgcagcgctccatttcaaattggttcagcttccacggtgtcagcgatatcggtttcttttttactgactggcagctcggacatgatttgtttgaggaagcggataagctttgggatcgttctcctgtaaaatatgcgtcccgcgtttcgacgccgcttttgatcctgcatggtgagcgagatgaccgctgtccgatagagcaggcggagcagctctttaccgcgttgaagaaattgaacaaaacgacgtcgttcatccggtttccgaaagccacgcatgagctgtcgagaagcggccatccggaacagcggatgaaacgcatccgttatatttgttcatggtttgatgactatttgtaaaaaataaaaaaccaggctgtcatgcagcctggttttatgattaaaatacttgttctacttcaacgacacccggtacttcttcaagaagggcgcgttcgattccggctttcagcgtaatcgttgaacttgggcagctgccgcatgcgccaaggaggcgaagctttacaatgccttcgtctacgtcaacaagctcacagtcaccgccgtcacgaagcagaaacgggcgtaatttatccaatacttcctgtacttgctctttcatttcaacctcagtcatgagattcgctcctttcatatacataaaaccattatattcacagtaacggtaaaaatctaatgtttggtttgcaaagctgctttccccattatagcatatttaaacttgaacataaaaaccgttttttatacaaaagctgccccgtcctttgtatactggtgtaaaggggatgatatacatgacaaagccggttacgctcagtgtttacggcgctgaaacgctttgcgcaagctgcgtgaatatgccgagcgccaaagatacgtttgaatggctggaggcggcgctgcaacggaaatatccggaacagccttttcacatgcggtatattgatattgacgcaccgcctcagcaaaaggagacagaagaacttgcggagcgcatcagaaacgatgaatttttctatccgctcgtgctggtggaggatgtcattgtgggggaagggaatccgcatttaaaagatatatatgaagaaatggaaaagcgcggctatgttgcgggctcttaaaaatggccgctgatcgcaatcagcggcttttttcttatcagccgttgtgatgcttgtacatccataaaaggcctgattttaataaacggggcacacgcccgatgagcggacggtcgttgacaagaccgaagcccgctttttttccgagtgaaccgagaacgcctttcagcttaaattgcggcattgtttccggcagctcttcattgttccagcgtttcaggaggatctgcacaatttgttccgcctgtgcttcagccagctgggcgctcggcgcatgcggcaggctcgcgcaatcaccgacgacgtaaacatgctcatctcccggaaggttgtgatgcggtgttaaaacgatgcggccttgcggatctttttcagcgtccagttctctgacggctttattcggctgaattcccgccgtccacacgatggcatcggccggtattccttcatcatgattataaacgatcccgtcttccacttttgtaatattcgcattattgataatggtgacgccgtgttcttcaaaccatttctgaacatacttgctgagtcttttcggaaagcttgataaaatcaggtcgccccggtcaaataacataatcttcagatcgtcacggctctctcttaattcactggcaagctccacgccgcttaatcccgctccgacgatagcgacagatgcattggcgccgaggttgttcagcttttgataggcttcgcgtgactgatcaatggtctgaatgctgtaagtatgttccggcgcgccgggcacgttatgatacttatcctcgcagcccagtccgatcaccgcgtcatcgtaagaaatcggttcgcggtcatgaaacagaacctgtttgtttttcgtgtcgacggaagccacctcaccgtattgaacatccagattcggatgctcaggaaaagacaccctgatatgatgatcagaaatcgtgccggcggcgagcgcataatattctgtttttaagcagtgatacgggtttctgtcaatcagcgtgatggatatatctgacggaagctggttcggcagtaagcggtgcagcacccgcatgtttccgtaacccccgccgatcaagaccaattttttcataatgattccccttttgcccgaaaaatatggtagtcaatgttgttacaaaataacgaactatgtaaaataacatcttgaattatatcgaatttgatctaaaaccacaataatagttttaaaataacctacaaattgaccagaaaacacgtaatagtaaaacctttaacctgaattaatatgttacgataacattgagtgtgaaaccggatctttgacgaatagaggaaattccgttaggataaggtacatatgtgaggtgaaaccgcatgaatccgatgattgaattctgtgtcagcaatttagcgcgcggttcccaggaagcacttgagatcttagagaaggatccgaacttggacgtgcttgaatacggctgtttaagctattgcgggaaatgcatggagtccctgttcgccctggttaacggcgaagtggttacgggaggcacgcctgctgaactggttgacaacatatatacattcatagaagaaaatccgatgttttaatcagaggctccgaacggggtctcttttttattgcgccccgggttttggcaaaataaaaaatttgtagacagcaaaaataaatattgttatcttaataaagactttttttaaataaaattttagaggtggattcattgaatatcgtttgggggctgctcggggcagttgctatattagccattgcttttttgttatcagagaagaaaagcaaaattaacctgcgaaccgtcattgtcggtttatgtttacaaatggccttcggattcatcgtattaaagtgggacgccggacgggccgtatttttatggttctcaagccgtgtgcagcttctcattgattatgcgaacgaaggcatcagctttatttttggcccgctgataaaagtgggcagcagcccggcttttgcgctgagcgttctgccggtcattatctttttctcagcgctgattgccgttttgtatcacttgaaaatcatgcagctcatctttcgcgtcatcggaggcggactgtcaaaacttcttgggacaagcagaacggaatcgcttgcggcggctgcgaatatttttgtcggacagtctgaatcaccgcttgccattaaaccgctgattgcgggattgacccgttccgagctgtttacgattatgacgagcggcctttcggctgtagcgggttcgacgcttttcggttacgccctgttaggcattccgatcgaatacctgctggcggccagctttatggcggctcccgccggtctcgtgttcggaaaaattttaatacctgaaacggaaaaaacgcagacgataaaaggcgattttaatatggacgaagaaggcgaaggcgccgctaacgtgattgatgcagcggcaaaaggcgcgtccacgggccttcagattgctctaaatgtcggcgccatgctgcttgcgtttgtcgcgctcatcgccgtagtgaacggaattctcggcggaatcggcggctggttcggtttcaaacatattacattagaatccattctcggttacgtgttttcaccgatcgcatttgtaatcggcgttccttggcatgaagcgctcggagcgggaagctatatcggacagaaacttgtgctgaatgagtttgtcgcttattcaaacttcggtccgcatattgcggacttttctaaaaaaacgtctacgattatcagctttgcgctgtgcggatttgccaacttctcttcgattgcgattatgctcggcacactgggcggtttggccccaagccgccgttcggacattgcgcgcctcggattaagagcggttattgcgggaacactcgcaaaccttctcagcgcggcgattgccggcatgtttatttagtaaacgataaaagctccctgcatatgcagggagcttttatgtatgaaaaacgggggatatttgtattgtgtccgagcagaagagcttttatactaagtaaaagaaaaaaagttggaggccgatatgaattcattccgttttaccaagatgcacggtcttggaaacagttatatatatgtaaatcaatttgaagaacagctgccggaagaacggctggctgagattgccgttaaagtgtccagcattcacacgggcatcggctctgacggaatgatcctcatctgtccgtcagaaaaagcgcccgtcaaaatgcggatttttaataatgacggctcagaagggaaaaattgcggcaacggccttcgctgtgtggcaaagtacgcatacgaacataagctgacagaagaaacgtcctttttcattgagacgctttcaggtctagtgaaagcagacattacagaggacaacgggattgtgcgtgaagtcgccgttgatatgggcgaaccgcgcctcaccaaaaaagagctgccgatgctcggcaatgaagatgaacggacgatcgatgaaacctttgtttttggagaaacggagctttccggaacagccgtatcaatgggaaacccccatattgtttttccggttgcggatatcaatcaagcgcctcttacaacgctcggtcccgtcattgaaaaagacccgagatttccggaaggcgtcaatgtcgaatttgtggaatccgtcagcgccgatgaacttcatttccgcgtatgggaacgcggctccggcattacacaggcttgcggaacaggcgcctgtgcggcggctgtcgcatccgtattgaacggtgtttccgaacgaaaccgggatatcaccgttcatttagcgggaggcgaccttgtgattaattggcaggacaacgggcacgtgctgatgacgggacccgccgaaaccgtatgcagcggcgtctattatttgtaaacagctcgtttgagaaatactctcctcaaggtttataatagatatcagcatccgttttttaaaaaaggaggtctacctatgagtgttccagtaaccatcactgaagcagcggctttgcatataaaagatatgatgaaagagcatgaagaagaaaacgcgtttctccgtgtgggcgtaaaaggcggcggctgcagcggcctgtcttacggaatgggatttgagcacgaaaaaggcgaaaaagacagcatgtttgaacagcacggaatcaccgttttggtcgacagcgaaagccttgatattatgaccggcacgatcattgacttcaaacagtccatgatgggcggcggtttcaccattgacaacccgaatgccatcgcttcctgcggctgcggttcatctttccgcacggccaaaaacgccggtacgccggaagagtgttaagggtcaacccgccattcttaggatgaaaaaatatgacgtctttctttccggtggcgcttgcaccattgttaaaaaaggcgtttatctgtttaataaaaggaaaacccgctcaacagaagcgggttttcctttttcaaagaggttattcgattgtatgtttcatagcatggtacatatttgccgtatgttcatcggctttatcccgtgacatgcgcagccgttcttctgaagaaccatatccgatttcttgtttgccctctttcagtcctttaaaaatcccatcagcgaattcatccagcggttctccttgagtatgcagccctgctccgcctaaatctgtattcaccgccggaggcgcaacttcaatcacttctacagatgaatcagaaagctgatgtctcagactcattgtaaatgaatgaagcgccgctttcgttgctgaatagatcggtgcaatggcaagcggtgtaaaagccaatcccgaagagacgttaatgaaagccgcatcttcttttccggcaaaaaacggagcgaacagcatagacaggtggaagggagcttcaatgttcgttgtgatttctttattgaaatagtcccaattgtccttcgcatccgctttcagcacatgaaaacgttgttgaatccccgcgttgtttactaacacattcacttccggataattttctttcacccaatcaaacagtgatatacgttcagatggaatgctcaaatcactgacatatgtaataagatccgggaatgtttcctttgctttttgaagagcgtgctcacgccgtccggtcacgataactttatttcccgcttttaaaaaccgttctgcgaaagccaatcctattccggcatttccgcctgtaatcagtattgtatttcccgtcagtttcatattaactcctcttttccgattgtttttacatttctttgtcaacatttcagctttgatccaatcaatatattcatcccgcaaataggcatgaaataagacagcagtgattctgtaaaattgatttttagatcatcgggaaacccgccaaaactattctttccttgtcacaatatgatgatacggcttaaagcacggtttaagtcaacaaaagaaccttgtgcttccgtttcggttactcacatcagacataggtcacgaaaggaaaggtgaacgtaaagtcttggaattttcttaatgcgataaagcgtaccgtatcatatgggtgagaggcaattaaaaaaacgtttctgatcaaaacaaaaggacggcgatgcatatgcaggaaggaaacagcgttgatatcaggccgctcagcttgaatgatgcagagcaggaactggttttgcagacggaaaaccgcatgttttttgaacggtttgccatgacgagacaagaggatttttatacgctggaaggccggaaaaaacgaattgaacaatcactgaagaatgcgaaaaatgatactgaatacagcttcggcatttttcttcaggatcagaccctgattggcacgatcagcctttttcaggtggttcggggttccctccaaagcgcttttatcggttattttttagatggcaaatataacggaaaaggctatgcgacgaaggctgttaagctggcagtcgaatatgcattcaatgagctggaactgcatcggatagaagccggagttatgccgaacaataaggcgtcaatccgggtgctcgaaaaagctggctttcataaagaaggcattgcgagaaaaaatgtaaaaataaatggaaaatgggaagatcatcaggtgctggcgatcatacatccggaggatacatgacgatatcctccttttttatatcctgcgtctctttcgacagattcttcctaaaacttcaaatcaattgtctaaatcatactatttgcaaattcgaaaaaaaataaagggtacatagcaccaaaaactctgaaagatgtgctctttgtcaacacgttctaaagtcatatttttcgaaaggatattgattttttgataggattaaactaaattgtaaaagtatagaatagttaatttattttgtaagaaaaggatgataatatgataggtcaattgagcaataaaaaaatatttttaagttcttttttcatcattttgatctgttcattactcttccaattcagtatttcagataaagttctgcagtcgtattattcttccgtcggagaaaatacctacgatatcggggagaaaagtgttcgtacgattgtcatgtttctgcaagggtttatgatcttcacaacttttgtggaaattctgataggcggatttctgttattcgttgccgcttttattctcggtacaaaaaaaccgaaaaaaatatatttgcttctatatacgctgacttctttaatctcggcatttaaaatgttgattctttcagttgttaactacttaacggctgattcctcgcttatatattctgccggcggcaccagcttgagtctgcagctgctggatccatttctgctcatatcaatcgcggctctttatgctgctgcgggaaaactgaccgatctcagtaaaggcaagagaatcattttgactggatgttttgttttactaaaactctttactattttcttaaactattttatggcggataaaatttagctcgggagagagtcaattaagctgaattttattataaattaaaaaacagagtagggagatgttatgatgaacttagtaaaatctaataaaaagtctttcattttgtttggcgcggctcttgctgcagcaacattggtttatgcactattattaacgggaactgaattaaacgtggcggcggctcatgcattctcagccaatgctgaattagcttctactctcggcatctctacagccgcagctaaaaaagcaattgatattattgatgcggcatcaacaattgcttctatcatttctcttatcggtatcgttacaggcgcaggcgcgatttcttatgcaatcgttgcaacagcaaaaacaatgattaagaaatacggcaaaaaatacgcagctgcttggtaaaatcgatcaataaataattgctctttttgtacaagctgcaaaaagagcctctctcccaaatacatatgtaaggattgaaagtatgatagtcaaacaaattgcggctcttatcaaatataataccctgtcatcgtttcgaaaaagaaaggaagattggggcattcctcaactcaacagcaaactgctgtctgccattattatttctctgttatgtttatatctcgttttcctgggatgcggtgttgtattcgggacaaaactgattcagctgcccctcagcgcatgggggcaatttgttttaatcgccgtttcacttgagcagcttttttgggctgccggcttctttaaagaacaccacaatgcctttctgctggatacgcgcaaggtcattcatcaattaaaaaaggttcgttttttacagctgttttctgtttttgccggccaggcgatcaaaaaaaccattttcgtatggtatctttttgtttttccggtctttttgtttttatcaagcgcaggcatgaccgggtctgcggcggtcatcgtatttttcttgggcttcgtttattttcttctcaatttatttttatctatgctgttttcttatgttgtttatcttcttacaaatatgtggagcaaattgttttacttgaaaatcatgaaaggcattttattcagcgtcagcctgctggttccgcttgcagtcgggtatgccgtttatcttctcgtgtttggggagtataccgcaaaggatatttcaagctttacggagtcaccggctttccggaacatcctcatgaatacgccgtatgtatggttagcattccgctcacattccgtgctcgttttcgccgcggtgtttgcggccgccgtccttttaacggcggggatgtttaaactgtggtcggccacgctgaagaaaatggaccttattccttatatgtttttgacaaacgcagattttgcgccaaagctgaaattatatagaaataacaaaatatttcatgccgtttttcaaaaggacctgctgtttttatcgagaattgacgggttttttatcaggaacttcggcagtatgctgtatttgttcatgctgtttttaggtttttgtattccgcttctatcgcatcattttatcgggtattcggcagccgccatcgtgtctgcggcggttatcattgcgaacttttcgtatcagctcgtcggagatgcgctcaaaacagtattatcagttgacggggaaataaaaaatcagcatctgtttcaccgaaatatcaaacatgcgtggcagctggtgtttccgaaagtatgtatttataatctcgccgctcttatctattcgttcatcatcaccattttgattacggtgttttttccgtcttccgctgcgctgacgatttacttgtttattgtgtttttatgttcgggttttttatacagtcttgtccagatttcaagcaccgccctgtatcctaagaaaaactgggagcatatgtacgaaattggagaagcggggaaagcaaagacgtataacaacttatacggatctttcattttcattgtgtcgcttcaaatcgctgcgatcacgtcgtattttatctataaaaagccggaacttgaaacgatgcttattcattctgcatcaggtatttttgtcctgttcacactattaaactatggagtcatgtttctgtttcttcgcagaatcaatatggcggaaaggtttgcgaacaatgattaaattagtgaatatacaaaaaaactatagtgaaaaacaggtgttgaaagatatttcgtttgaggtgaaaaaaggctcaatttatgctttgctggggactaatggagtcgggaaaacaacgactttgaaaatcatttcgggcctgcttaaaccgacttcaggcagcgtcatgattgacggtaaggaactggattcagaagagggggggcaaatatcggctgatatcggttttgtgcccgaccatgcctttttatatgattacttaacgggagtcgaatacttgcgttttacagcggagatgtttgaagtaccgtctcagcggacaaatgagtatataaagaatatgttagagacgctgaagcttgctcaagacggaaatcagctgattaaaacatattcacatggaatgaaacaaaaattatcaattgcggccgcgctcattcatcagccaaagatattaattcttgacgaaccgctgacgggcattgatttaatcagcggtaaaacgatacggacgttattaaaggaatacgtcaaccagggacatacggtcctgttatcgactcacttgctggagctggcgcattcgctgtgcgatacgatcggtattatacatgaaggcgtttttgcggcggagtatcagtcatccgagcattcattagaagagattgaaaaattggctgagagtatttatacatgatgaaccgcatgttgccggcaatcaggacgtccgccattccgttaaccgcatcattgctgtttttttcaggcggtgtgatcgctgcgtttttttccgatcactttgtttcaacagcgtcttacaacggctcgtcaggcgcggttgaactgctgaaaaacaatgcaatcgcttgtctgtttttagccgcggggttttttacctttgggttgacctcaatcttttatttattcaccaacgggtttattttaagcggctctattatagaaaatctgcatagcggagttcctttttatcagatttttttactgctaattcctcatggtatatttgaagttcccgcgttattattaagtggcgccattggttttaagggcgttgaattggtcatcaggctgtgtttttctaaggaaaaaaagataatggcttcaatgttcaggcatattggaatattggtgctcataattatttgtctgctgatcgccgctgccattattgaagcttacatcacaccaatttttaagtaaaaggggcagaaatcatatgagaagtaaattatcattaatcggtgtgccgattgttatgattatcggttatatcatttctttatcctttgagtggctgtttcctgttcttacttttggggtggcaggactgtatctctttatatttgcaccggtgcaaaataaattcattcgttacatctttttgtttatttttgtgattaatctgttggccagtgcggctctttatttcggtatttaataaaaaaatgacattcatattgaatgtcatttttttattttttttttgcggctctgctgcgtgttaaaatctgtcgccgttgaaaatagagttttttacgatcacgtagtcgacattgcggatggcttcgagtgtattgccgccggcgtaagagatggaagattgcagatcctgctccatttcaaccagcgtgtcctgtaaagaccctttatgttcgacatgcatttttttgccttcgacgtttttcttttcgcctttttgaaattcagaagcggagccgaaatattctttgtacagcttgccgtcgatttcgatcgtttgtcccggtgattcttcgtggccggcgaataatgatccgatcatgaccatggatgcgccgaatcggatggatttcgcaatatcgccgtgcgtgcggatgccgccgtcagcaatgatcggtttgctcgccgcttttgcgcaccagcgaagcgcggctaattgccacccgccggttccgaagccggttttaattttggtgatgcagactttcccggggccgattcccacttttgtcgcgtcggcgcccgcgcgttccagctcccttacggcttcaggcgtcccgacattccctgcgatgacaaagctttccgggacatgttctttaataaattgaatcatgctgatcacggcattggaatggccgtgcgcgatatcaatggtaatataatccggcacaagctcctgtgctttcagctcccggatgaattcataatcattttccttcacgccgacactgatggaagaaatcagtccgcgcgctttcatatcccggacaaaagccaggcgtttttccggctcgaagcggtgcatgatataaaaatacccgttttccgcgagccaggccgcgatgttttcatctattatcgtctgcatgttggccgccacgaccggaagtttaaacgtgcgtccgcccaatgtaactgatgtatcacattcagatcggctgtccacaatgcattttgcaggaatcagctgaatatcttcgtaatcaaatacattttccatatataacacccctaaaagcgaataatagaattaaataaaattaaaatgttcgtctttttataatgtactttgttttgtcaggaatgtcaaatgatttcatgctgcctcatatgcggtcagcttgtcatccatttgcagtttggttatcatagtagtattgggtgttgtaagacatttgttacgatagatagatttgcaaagaagggaggggtcggtgtggaacaaaaacagcccgggcacagcccgaaagcccagaaaattcaggaccggattattttaggcacgatttgggtcgtgtcggcgcttgtcattgcgctcgttgtcggaaccgtcatgaattatatttggatgtttaaataaaaaagagtctgtgccggtatgacacagactcttttttatattatttttcaaacatgcttgtagaatgcattggctggacacgcgctttcgggtccatgtaggccttcgcgttgttcacggctgtcggagcttcgccgaaaccgctggcgatcagcttgactttgccttcatatgtgcagatatctccggcggcaaagaagccttcaatattcgtttccatcgtgcttttgacgacgatggaatttttctcgatgtcaaggccccagtttttaatcgggccgagagaagaaacaaagccgtagtttacgatcaggtcatcaatttcaatgatttctttacggtcgcctttcacttcttcgagaacgagctgttcgatccggtcttcaccgacaagttcagcgggaacaaacggtgtcagcacgttgactttagaattatgcaggttttcgacactgtgctcatgcgcgcggaatttatcacggcggtggatgatgctgacttctttcgcgatcggctcaagcatgagcgcccagtcaaccgcggaatcgccgccgcccagaacggcaacgcgtctgcctgcgaattgattgaggtcgtcaatgaagtaatgcaggtttttgccctcatattgttccgctgattccagctcaagctttctcggcttaaatgcgccgtttcccgcggtgataataaccgtttttgaataatgcgtttctgaattcgtgacaagcttaaacacaccgtccgcctgtttttcaacagattcaacggcctgctctaagcagatggtctgatcgaactttgccatttgctcttttaagttgttcacaagttcttgggcgcggattttcgggaatccggctacatcataaatatatttttcagggtacagcgcgctgagctggccgccaagctgaggcaggctctcgatgattttgacgctcgcctgtctcattcccccgtaaaaagcggtaaacaggccgaccgggccgccgccgatgaccgtaatatcataaacctttgaatcctcttgcataccaaattgcctcctaattgaaaattgttattaattataacatacaatttaaaaggatgacgagtgccgaaaaccgcccggccgcttcattcttgaaaaaaattgcggccgccgctaatatggggacaaattccaatctgttttttcctgaatgttttctgattcttccggatagtatggtgatatgcagacatgtgcggttttctaaaaaattttatatttcatttcataaaatcccgccaataagctgaagctaatacaaatgttgatttgattatgcgtctaacagcaaaaaaaagaaggtggatgtgatggcattgaataaacccaaaatcgtggttttaggtgcaggttatggtggattaatgacagtaacaaggcttccgaagcatatcggggcaaatgacgctgacattactttggtcaataaacacaattatcattatgaaacgacatggatgcatgaagcgagcgcaggaacgctgcatcatgaccgctgcagatatcaaataaaagatgtaatcaatgaatcacgggtcaaatttgtgcaggataccgtaaaagcgatagatgtgcaaaataaaaaggtgacgctttcacaaggggacatcccttatgattatcttgtcatcgggcttggcgccgtccctgaaacattcgggattaaaggcttaaaagaattcgcttttccgatcgcgaatattaatacgtcgcgccagctgaaagaccatattgagctccaatttgcgacatacaatacggaggccgaaaaacgtcctgaccgcttaaccatcgttgtcggcggagcgggctttacgggaattgaatttctcggtgaacttgcgaaccgcaagccggagttatgcagatattatgatatagatgaaagtctcgtccggatcgtctgtgtcgaggccgccccgacggttttgccgggatttgatccggagcttgtcgattacgccgttcaataccttgagagcaaaggcgttgaatttaaaatcggcaccgcggttcaagaatgccgcgcagacggtgtcacagtcggcaagaaagatgaagagccggaagaaatcaaatcccagaccgttgtctgggcggcgggcgtgcgcggacatccgatcgtggaggaagcgggttttgaaaatatgcgcggccgtgtcaaggtcaaccctgatcttcgggcgccgggtcatgatgacgtttttatactcggcgacagctcgctctttatcaatgaagagacggaacggccgtacccgccgactgctcagatcgcgatgcagcaaggagaaacggtcgccaaaaatctgggcggtttgattaaaggaggccagcttgaagagttcaagcctgacattaaaggaaccgtcgcctccctcggtgagcataacgccgtcggagtcgtatacggcaggaagctcaaaggcatgccggcgtcctttatgaaaaaggtcattgacaaccgatcgctctttatgatcggcgggctgggcctgacgctgaaaaaagggaagtttaaattcttctgaaaacccgcggccgcgggttttctcttcttttaaaaaagagcgctatcaaaagaatgtaaaagaaaaaaatgaatgttttcgcttacatgagttattttgttacatattctgacttggtgcttgacaagtaaatatgatatattatcagaaaattaagaaaaagggtgatccgcatgaaaacgacagcaaaaagcacggcggcgtgtccgttctgctcaggtaaagggtattttcaattgcttcttggcggctccgaaacatgtccctcctgccagggaagcggcaaagagagacgctgatttttccagacgttgacttttttaccgcccccgaggtacactgaaagtgctgtagggggtggatgtttgtgattagtttgccggttgtcctgatctcaattgtactattttttgtactgtttttcggcataggctttctgttgaacatgctgcttagaatgtcgtggattatggctgttgtctatccgattgtatgccttttcattatcagcaataaaaagatgatcagttacgtgcaggcgccgggggaatcctttcaaagcctgtttcagcgcatcatgtcattagcggttgcggatgtcgtgattttggcgggcggactggcgggagccatcatgtcaggcattgccataaaggcgctcagaaaaagaggatatcaaatgttttaagccgctttcttattcgagaaagctttttttgtgccgcggcgctttttgtatagcaccccaccgagttgggaacaatgactcggaggagagtgatttcagattgacgataatcagacgcgtattcatgatcgtgctctttttgggcgcatgccatgcgacatacttttccataaccggagttgaagcaaaggatctgacaaattggatgacggaacatcgcggcgccgttttgaaaaacatcggcactccgtttcaatccttacagaatcagccggaaaagaaggcatcaggcaggataaaaccgctggaagaagcttttgactgggaacgctatccgtcacaaaaggtgacggccaccggttataccgccggagcggaatctaccggaaaatctccgggtcatccgcagtacggaattacatattcaggcgtgaaggtcaaacgcgatttatattcaactgttgcggccgatccgtctgttttcccgatcgggacgattctgtttataccgaattacggatacggggttgtcgccgataccggctcaaaaattaaaggaagccgccttgacctctactttgacaccgtcaaggacgtctataacaattggggcaaaaaaacacttgatgtctacatgattaaaaaagggaacggcacagtgaccgaggacgaacttgtaaagctgaacgaaaccaagtcgatgcaagtgttcagaaatcaatacaaaacggtaaaagaataaaaacgcttcagcatccgctgaagcgttttttacataaagaaataatctaaaatcaatgtcagcacaataccggtgacgccgccgaagaacacttcaatcggctgatggccgagcagttctttcagtttcttctgtttttccttctcttccgctttctgaaagtccttcgcttcgctgacaaaccgattaaagtcgatgaccagtttattaatgaccgtcgcctgttcacccgcatgccgcctgacacctgtagcgtcgaacatcgtaatgacggcgaaaatcgcggcgactgcaaacaggggcgagtccagcccctgttccaaagcgactccggttgacagcgcagtgacggcggcggaatgggagctcggcatgccgccggtgctcgtcacaagagaccagtcaagttttttggatacgataaattgaataggcacttttacaacttgggcaaaaataatggcggcaaaactcgccagtaaaggaaaattcataagtacatccatatgcaacatcctttctgtatctgctgattccgatcgtatcgaaaaactgcagaaaacgcccttagtttggtaaaataaaatcaatgaaaaatgttttttcattataccactttacataacaaatacccacataaggagtgtgtactcatgttttatgcatctgatcaactgcggcatcccgaaacactggtcatcggtctttttcaaaaaagcacgctgaacggatttacgaaggaattggatgataaattggacggtcatctgacccagctgttaaaggatggtgatgtgtccgccaaacgcaatcgtgtatcaaaagtataccctccggctgcgaccggtatgaaacgtatttattttatcggcctgggaagagaagcggattattcgtttgaagatacgaaagaatgctttgcacgagtatttcagcagattcatcaagataaaaaacaggaagtatccgttttgctcgatacattcgtctccggggaagtgcctgccgccgatgccgctcatgcgctttcagaaagctgtctgcttgcggtttacgaagtgcaggattataaacataaatcgaatgagccggatcaggaactgaaatcagtctgcgccgtgaccgaagaagacctgagggaagtgcaggccggcctgaacgtcggagcggcatacggccaagggacgaattcagcccgcacgcttgtgaatatgccgggtaatatgctgacggccactgatttggcgtcatatgccgctgagctggcggcaaaatacgatttcgagtgtgaaattttagaaaaagatgaaatggaagagctcggcatgggcgggctgcttgctgttaacaagggctcatccgaaccgccgaaaatgatcgttctgaagtatcagggcaaagatcagtgggaagacgtcatcggcctggtcggtaaaggaattacctttgatacgggcggatattcaattaagccgaaaaccggcatcgtcggcatgaaaagcgatatgggaggggccgcctcggtattaggggcaatggagattatcggcgaactgcggcctgaacaaaacgtgctcgccgtcataccgtctacggacaacatgatttcgtccgatgcgatgaagccggatgatgtcatcgtttcgctcagcggaaaaaccgttgagatcctgaacaccgatgcggaagggcgtctcgtgcttgccgacggcatcacttacgccaagcagcacggagcctctgtccttgtagacgtcgcaacgttaacgggcggtgtcattgtcgccttagggaacgaaatgacgggcgccatgaccaatcacgccgcgttttatgaacaggtggcggaatcggcgaaagaatccggcgagccgatctggcagcttccgattacagaaaaggataaaaaacgggtgagaaacagtcagatggctgatttgaacaattctccgggaagagaaggccacgcgattatggcgggggcattcattggtgaattcgcggaaaacacgccgtgggttcatctcgatattgcgggaaccgcaacggcgaataaagcgacatgcttcggccctgccggcgcaacaggcgtcatggcaaggacgttggctgttttgactgagcgctttacgcccgaaagataacagtatcccgctgccttgatgcagcgggttttttgatttccaaaatctttagttgactaaagcgcagaatatatggtaactttaattatctactacattagcaaactaaaggattttggagggactcatcaatgaatgctgttgttgtcgcagtattgcttatgctcgtcttaagcctgctgcgtgtcaatattattatagctttaatgatcggcgcgcttgccggcgggctgaccggcggcttaggcctcggagagacggtgaaggcttttacggacggtctcggcggaaatgccaccgtcgcagtcagctacgcgctgctcggagcatttgccgcggcgctgacaaagacggggcttcccgatgcaatggtggaagcgtctgtcaaactaatcggaaaaaaggaagattcgcggaaaaaagcactgtcaaaagtattaatcgtactgattattttaatcatatcctgtttctcgcaaaacgtggtgcccgttcacattgcgtttattcctgtattgattccgccgcttttaaaaatatttaacgaacttgaaatagaccgcagactgatcgcgtgtgtgatgacattcggactgactgcgccttatatcgttctgcctgtcggattcggacagattttccaggggatgctgagagataatatggcgtcagccggtttaaaggtgccgctcagtgatatcccgtatgctttaatcatcccgacggccgggatggcggtcggtttaattttagccgtcatcgtcttccggaaaccgaagaaatatgagacgaaggagattgccggactatcgtcttctccttatacgaaaaaaagcattgccatcgccttgatctccattgccgtgtcgcttgccgttcagctctatctgtcacaagtgctcggagtggaaggtatgattatgggcgcgcttgccggcttgtttacgctgtttatcagcggagtcatgaagcgcaatgaagcggataagctgatcacggacggcatgattctgatggcttttatcgggtttgtcatgcttgttgcggccggtttttcaaatgtattgaataaaacgggtgatgtggcttccttggtcaaagcatcaacaggctttatcggccacagccaatcattgggcgcgctcctgatgctggtggtcggtttattaatcacgatgggaatcggatcatcatttgcaaccgtacccgttattacgaccatattcgttccgctgtgcgctcagctcggattcagcccgatggcgacgatcgccgtaatcggagcggccgccgcggtcggtgatgcgggttctcctgcaagtgacagtacgctcggcccgacgtcaggcctcagcgccgacggacagcaccaccacatttgggatacgtgcgtaccgacatttattttctataacattccgcttgtgatattcggctggattgccgcacttgtcctgtaaaaaaaggctcccggaaaggggagcctttttgtatgctgagaacatcttacgccgggtttctgctgaaccccgtcgctttatgaatagacctgtaaacggcaggcgcgattgatgccaataacagtgctaaaacgatatcttttatgaaaaaccatatcatgtaaaaccaggccattccgtagctgatcggagcatgaagccataattttagcgcaatatacgtataggtcgtgccaatgatataaatgacggcggtaccgatcaaagaggcccatgcataatgcaggcggccgggtttttttgttttttccagcagccatccggctgcaaatgccgccgggatataagcgagaataaatccgccgctctttccgataaacggcgcaaagcctgctgagaattgagcgaaaacaggcgcccccgcgagtccggccaatgcgtataccgtcattgcaatggctgcccgtctggcgccgagaagcatcgcggctaacagacaaaagaaaggctgcagcgataacggaattcccgcaacttgcaaaaaaggagccattgatgtaatgttggcgccgacggccatcagtgcggcaaacatgccgataagcgccatatcgcccgcgcgaaggttgcgttgtttcatttgtttttcccccttacacttgtaccagattagcgtaatcgaagggtgattgattgtcaacaaagatttaacacaggtttactaaatggagggagccatatgtttttcgggaaaacgaaacaaacaaaacagtcggaacggattccgccaaatcaaaatgtcacaacgaagtttcccgtgcttcacgccggaaatgttccttattatgaagatatgtcaaaatggaatctgcaagtgtacggacttgttgaccgtcctatgctgttaagctttgaagatatcaaatcctttcctgaagccgaagtgaaaaatgatattcattgcgttacgggctggtcccgtcttgataatatctggcagggaatacgcgccaaagacatcgctgagaaagcgggcgtgcacaaagaagcgggattcgtcattctgcacgctgaagagggctggacggccaacctgccgctttctgattttgcgcgggaaacatccctgctggcatatgcgcataacggcgagccgttaacgccagagcacggctatccgctcagaggcgttttcccccatctttatttttggaaaagcgcaaaatggctgcgcggcattcagttcacaaaggaaaaccaccccggcttttgggagaaaaacggctaccatatgaggggagatccatggaagaatgagcgctttacatgggattaagcccctatcactatatagttcttaggtaccttattgaaataaggtgctttttttatatcaaaaatccattgactttgtttggcaaaaaacctattatttgaggtgtcttttgatattgaaaatcattatcaataagcatagataaagcaattgccgcaaaggggatgaacacataatggacggaaaacaaataaagcggggtttcgcgccggccggccgatacgcggttccgggcacagaagtaagagaaatgcgctcaaaaggaggccgtatgtatcgtatctttgtctcttttcctcaggaagaaccgcctgcatccggcttccccgtcatatacctgctcgatgcgaattccgtattcggcacaatggccgaagctttgcgggtgcaaagccgacggcctgaaaaaacaggcgttgttccggcggtgattgtcggaatcggctacccgacagatcagccgttttccgccgaacgtcacagtgattttacgatgccgctttctgaatcagaactgccggtgcacccgcggggcgcggcatggcccgaacagggaggggcggaagcgtttctgagttttatagaagaagaagtaaagcccgcgatggagcgggattatccgatcgacagaggcaggcagacgattttcggccattcgctgggcggtctttttgtgctgcaagtgcttttgacgaggccggacatgttccagacctatgttgccgggagtccgtcaattcactggaacaagcgttttattcaggaaaaagcggaacgtttgtcagaccggctctctgcggaaaatcttcaagtcagcgtattgctggctgcgggagaaattgaaaaaacacataaaagcagaatcccgcagcacgcagaggcgctgtactctttattatccggatttgaagatgatggagtccgtgctgaatacagcgagtttgaaggagagggccatatttctgtcctgcccgttttaatcagcagggccctgcgtttctgcctgaatccgggaggaccgcataccccgtattctcccgcatgagaaaaaacaggcccttcgaactaaatgcggctgattctaattttctaattgactgcgtgttttgatttggatatgattgtcttgaatcatagttgataatgataatcattatcaatatagaaagggaatgataatatggacgcattgggaatgaaagggaaaacggccgttgtcaccggcgccgctcaaggcatcggagaagcaacagcgcttgcccttgctgaacaaggcgtaaatgtggcagctatagatacaaatcaagacttgcttctcgggcttactgacagacttcggaaaaaaggcgtgcaggcgcaggggtttgccgcagatgtatctgacagtgcggctgtcaatgatatcatcgccgccgttgaacgcgacatgggacctattgaaatattggcgaacgttgcgggcgtgctgcggccgggtccggtgcaatccctcagtgatgaagattgggatcaaacattttctgttaatacgaccggcgtatttcatgtgtcacgggctgtaagccgatacatgattgagcgtcaaaaaggcgccatcgttacggtcggttcgaatgcagccggcgttccgcgtgcttccatggcggcttatgcggcgtcaaaagcggctgccgtcatgtttacgaaatgcctcggactggagcttgcggcccatcatatccgctgcaacatcgtatctccgggttcaacggaaaccgacatgcagcgggcgctgtggcaggacgggaacggagcccgggacgtcatcagaggttcgcttgatacatataaaacgggaattccgcttcaaaagctggcgaagccttctgatattgcaaatgccgttttgtttctggcttctgaacaggcaaaccatattacgatgcatgatttatgcgttgatggcggcgctactttaggcgtttgatgtaacgagaaggagggacaaacatgacaaatcaacatttatcggcggaagtgtctgcaaaagaggtgctggacgcttacaagcccggggcgttctttttagcttccccgaaaagtacgatgcttgcggaaggaatgtttgcggaagtgcctgatacagacgcggaaaatcagctggattcactgcctgaacgcgtgagacagacgcttcttgaggcaaagcaagccggcatcaaacatccgattgcggccggcgccattccttttgacggcagaaaagcttcccggctttttgtaccgaagaatgtccatacggcaggcccgctttcgtttgcggaatcttccgcagaaaagccgcaatccaatacatatgacatccgtcccgttccggagcctgagggctttatgagcggtgtggaacaaggcgtattcagcattacggacggtccgctcagcaaaatcgtgctgtcaaggacgcttcatctgaccgctgaaaaggatatcgacattccacaggccgtcaagcatttggcgcagcacaacccgcgcggctatacattcgctgcggatgtgacgggaacgtcagaaacaagaaaaacgcttttcggcgcaagtcctgaactgctgctgtccaaaaacggaacatcgattctgtccaatccgctggcaggttccagacctcgcagcacagatcccgccgaggatcagagaagagcggaagaactgctgcaatcagcaaaagatctgcatgaacatgccgtagtcgtggccgccgtggccgccgcccttaaaccgttctgccgtgtgcttgatgtgccggaaaaaccgtcactcattaaaactgaggcgatgtggcacctgtccaccgaggtaaagggagagctgcgtgatccgtcaacgacatcacttgagctggccatcgccctgcatccgacacccgcggtatgcggaacgccgacggatgcggcgagagaagcgattcaggatattgagccgtttgaccgcaatttctacacgggaatggcgggctggtgtgatgctgagggtgacggagaatggattatcgcactccgctgcgccgaagcggaaacaaggtctctccggctctttgcgggtgccgggattgtcgccggatcaaagccgcaggatgaattggacgagacctcggccaaattccgcaccatgctccgggcgatggggctttaccaagatgagttgtaaaaaaggagggaacggatcgtgctgactggattttcgccatggccggaagaatgggctgacaaataccgaaaagacggctgctggaagggtgagacgttcggaggaatgttgaaagagcgcgcggctttatacggaaatcaaactgccgtgacgtgtaaagatgtacattggacctacaaagaattagatgaaagggcagatcgtttagcggcggggctgcataagctcggaattcaaaaggaagaccgcgttgtcgttcagctgccgaatatcgctgagttttttgaagtgattttcgcgctgttccggctgggagcgctgcccgttttcgcgctgccttctcatagaagcagtgagattacgtatttctgcgagtttgcagaggcgaaagcatacatcattcctgatatgcattcaggttttgattacagggcgcttgccagacaggtgaaagacaaacttccggatttggcgcatgtcattgtggccggcgaagctgaagagtttcaagaactgagcagcctgcatagagagcctgttcagctggaagaggtaagcccggcggaagtcgcctttttacagctttcaggaggcagtacggggctgtccaagctgattccgcgaacacacgacgattacatatacagtttgcgcatcagcgcggaaatatgcggcttggatcaacacagcgtttatttggccgctctgccgacagcgcataattatccgctcagctcgccaggtgtgctgggaactttatatgccggaggccgggttgttctgtcaccgacgccgagcccggatgactgcttcccgttaattgagaaagaacgtgtcacgattacagcgctcgtcccgccgcttgcgatggtgtggatggacgcatccggttcgcgaagtgatgatttatcaagccttcaagtgctgcaggtgggaggcgccaaattcagtgctgaggcggcccgccgcgtgaagagcgctttcggatgcacccttcagcaggttttcggaatggcggaaggattggtgaattatacgagactggatgatcctgaagagatcattgtcaatacgcaaggcagaccgatgtccccttttgatgaggtaagggttttagacgatgacgggcgggatgtcgcccccggtgaagcgggacatttgtttacacgcggcccttacacgattcgcggatattataaagcgcctgaacataatgaaagatcattcacagccgacggattttatcagaccggcgatatcgtcaaactgacggcggacggctatatcatcgtcgaagggcgtgcgaaagatcaaatcaatcggggcggtgaaaaaatagccgctgaggaggtggaaaatcaccttcttgcgcatcctgccgttcatgacgcggccatggtttcaatgccggacgattttctcggggagcgatcctgtgtgttcgtcatcccgaaaggagaagcgccgaaaccgggagagctgaaagcatttttacgtgagcgcggattagcggcatataaaatccccgaccggattgaatttatcgcttctttcccgaaaaccggcgtcggcaaggtcagtaaaaaggatcttcgcgaaacgatcgcccaaaaagtaaagccggctgaaatcaaacaatcttaaaaaaggaagtgtttacattggctataccgtctattcccgcatatgcgctgccgacagcgtcagatatgcctgaaaataaagtatcttggacgctgaatccgaaacgcgcggtgcttctgatccatgacatgcagaattatttcgtcgatgcttttgcgaaaggtgaagctccgatcacagaggcgtctcagaatatcaaaaaaataaaagagcaatgcaaagcactcggcattccggtggtgtataccgcacagccgggcagccaagacccggcggaccgtgcgctgctgacggatttttgggggccggggctaaaaagcgggccttatgaagaaaaggtcattccggagcttgccccggatgatcaggacattgtcctcacaaagtggagatacagcgcgtttaaacggacgaatctccttgagatcatgcgtgaaagcggcagagaccagctcatgattacgggaatttatgcacacatcggctgtctcgtcacagcctgtgaagcatttatggatgatatccaaagcttctttatcggagacgccgttgctgatttttcttcagaaaaacataagatggccatcgaatatgcgtctcagcgctgcgcttacacagctttgacaaacgaagtgctggagctgctgggcggcgcgccggtttctggaggagaagagaaggtttccgccgtattgacaaaagaccgggtgcgggaacaaattgcggcgattcttcaagaatcaccgtctgatatttcggatcatgaagacctgctggacagaggtcttgactccgtcagaatcatgagccttgtcgaacaatggcgccgtgacggagctgaagtgacgtttgtggaactggcggagaacccgacgctggaagagtggtggagacttctttcttcccgatctcaaaaagtcttgccgaacgcagattatttataaagggagagaatagaatgcatgatacacaacagctgcctctgacaggcgcacaggccggtatctggtttgcgcagcagcttgatcctgataatccgatttacaatacaggcgagtacgttgagataaacggcgcgatcgatgtgaacatatttaaaaccgctctcgaacgcgtgctgacggaagccgcgtcattacacgcccgcttcgaggagggagcagacgggccgaagcagatcatcaatcctccatttgaggctgcgatcgatgtcatagatgtgagttcagaagctgatccgaagcaggccgcactcagactcatgcagacagatttggctgagcccgttgatatggcggccgggcctttgttccgcgacattttatttcaggcgggaccggaacgctttttctggtatcagcgcattcaccacattgcgatagacggctacggtttttcactgctggcacggcgtacggcgcaaatgtacaccgcaatacgggaaggacgtccggataacgggcgctccttcggttctttggaggatctggtaaaagaagatcaagagtaccgcgcgtctgatcaattcctgaaagatcgggaattttggatggagaaatttgcggatgaacctgatgtcgtcagtttggcagaaagagcgccgcgaacgtcaacacgttttcggagaagcacggcttatctttctgaaacggctttacagcatgtaaaagcgattccgaactggcatgaagccgtcacggccgcagcggcggtatatgtccatcggatgacaaacgcaggggatatcgtgctcggtttaccgatgatggggcggatcggctcaatttcactgaatattccgagtatggtcatgaatcttctgcctttacggctttctctccgcccggatatgaattttcatgaggccgtcagccaagtggcaaaagaaatccgaaacatccggcgccatcagaaataccgccatgaagacatgcgccgcgaccttaaattgctcggagaaaatcgcaggctgttcggcccgcaagtcaatgtgatgccgtttgactacgcgcttgatttcgccggagcgcgggggaccgttcataatttatcagcagggcccgttgatgatttgtcaattaacgtttacgacagagcggacggaagcggaatgcgtgtggactttgatgcgaatccggaagtgtacagcgccgaagatattgaaaaccatcaaaaacgattcctgcttctgttggaatccgctgtgaaagaccagacacaaaaaatcggcacactcaaccttctgcttgaaagtgaacgtctccgcgtactggaaagctggaatgacacgcgcaaggccgagaagcagaaaagtctgccggagctgttttacgaacaggccgtaaaaacaccggaccggccggcaatcatcaccgaaaacgaagagctcagctatgccgaattgaacaagcgcgcgaaccagcttgccggcatgctaaaggaaaaagggctcggaccggaacaatttgccgctttgctgcttccgcggtcacaggagttggccgtgggcatgctggccgttttgaaaacgggagccgcatacctgccgcttgatcctgattttccttctgagcggatcacatacatgctcaaagatgcacagcctgcatgcctgattacaacgatggaattatccggccgcatgccggaagacagtgatgcaaaaaggatcattctcgatgacccggatacggtaaaaaccgttgccgctcaaaatgctgactgtcccgctcaggcggaatgttcgcctttgcaccccgcttatatcatttatacatcgggctcaacgggcaaaccgaaaggtgtagtcgtcactttaaaaagcgtaagcaatttcctcttatccatgcgggaaatgtttacgctcggcgaacaagaccgcctgcttgccgttacgactgcggcgtttgatatttccggacttgagctcttcctcccgctcatcagcggggcggggtgcgtcatcgcacgtaaagagacgattcaggaaccgcgggcgcttgcgcacatgattcactcatacggtatttcaatcatgcaggcaacgccgacattgtggcattcattagtcaccaatgaaccggattctctccgggcgctgcaggtgcttgtcggaggtgaggcgcttccgaatgcgcttatgcatgctctgcttgaatcaggctgtacggtgacgaatctgtacgggccgactgaaacaacaatctggtcggccgcacagccgcttgcaaaaggccatacaggggcgcctccgatcggaacgccgatttggaacacgcgggtatatgtgctggacgccgcattgcagcccgtcccgccgggaatcgcgggcgagctttatatagcgggggaggggcttgccagaggttattataaccgtcctgatttaacagcggaaagattcattgccgatccgtacgggcccgcgggcgcgaggatgtaccggacgggagatctcgtgcgctggcgtgaggacggctcgcttgattatatcagcagagccgatcaccaaattaaaatccgcgggttccggatagaattaggagaaattgagtcagtgctgtcgaaatatccgggtatttcgcaggccgccgtcattgtccgtgaagaccagcccggagataagcggctggcggcttacgctgtcgcggatcagccccttgatatcggcggacttcgtgaatatatgggcgaaagcctgccggattatatggtgccgggcgcgtttgtacagctggaagaattgccgctgacaccgaataagaagctcgatcgcagcgctctgcctgcacctgatttttccgctgtcctgtctgacagagggccgcggacgccgcaggaagaaatattatgcgatctgtttgccgaggttctcggtctcgcgcgggtcggaattgatgacgggttctttgaattgggcggacattcgctcttagccggacgcctgatgagccgggtccgggagacgatgggcgcagagcttggcatcggccgtctgtttgatacgccgaccgttgccgggctcgccgcacagcttgacaccgcaaagagtgcgcggcctaagctcaagccgtttgaccggccggagcatatcccgctgtcatttgcgcagctgcgtctatggtttctctactgtcttgaagggccaagcccgacttacaacattccggtgattgtccgcatgtcaggcaagcttgaccaatcagcgctgaaacacgccttttacgatgttgtcagccgtcatgaaagcctgcgcaccgtttttccggaaaataagggatcatctcatcagctcattttatctgctgaagaagcccgccctgtgtttacagtgacacgtgcagacaaaaacgagctccaagacatgcttgccgctgcggcacgatatcggtttgatctcgctaaagagccggccgtccgggccgagctgtttgatcatggtgacggcgagtatacgctgatggttctcctgcatcacatcgcaggtgacggctggtccttgaatccgctcatgcgtgacttatccatagcctatatcgcccggcaaacaggtgaaaaagcagaatgggcgccgctggcgattcaatatgcggattatgcgctttggcagcagcagcttttaggcagcgcgtctgattctgagagcttaattgcgcgccagctggatttctggaagaaaacgcttgaaaatgtaccggatcagctggagctgccgtctgattttccgcgtcccgctgaatcaagctacaggggcggcgtcattccggtcaacatcggccaagagcttcatgcccgtcttctctcacttgccagaaatcagcgcgtaagcctgtttatggtgcttcaatcagggctttccgcgttactgacccggctcggtgcagggaccgatattccgatcggcagtccgatagccggccgcagtgatgacgcattaggagaccttgtgggtatgttcattaatacactcgtactgagaaccgatacctctggcgatccgagcttttgtgagcttcttgaaagggtcagggaaatgaatctcgcagcatatgaacatcaggacgtgccgtttgaacgtctcgtggaagaattgaatccggttcgttcccggtcaagacatccgctgttccaagtgatgctcgcattccaaaatacgcctgaccctgtactcagtcttcctgatatggaaacaagcctgcaaatcagcagtgtcggatcgtccaaatttgatttgacgctggaattggctgaacagcgccatgacgacggcacgcctgccggtattgaaggtctgctggagttcagtacggacttatttagaaaagaaacggctgaagcacttgccggacgcctgcttcttctgctcgaagatgccgcatcacatccggaaaaaccgatcggaagcttaaccattctttctgatgaagagcgccggaagcttttgccggttaaacgggcaaaacagcatattcagcctcggcagacactgcctgaactgtttgaaatacaggccgccgcaaaatcggatgaaacggcggcagtttttgaagagagcggactcacttataaagagctgaatgaaagagccaatcagctcgcgcacatgatgattgcccgcggcgtcggcccggagcagtttgtcgcactggcgctgccgcgttctttagatatgattgtcgggctgttagccgtcctgaagacgggggcagcgtatttgccgcttgatcctgattatcccgcggaccgcatcgcttttatgttacatgatgccaagcctgtatttatgctcaccaaccgtgaaggcgcaagtaagctctctggcgaaaacggcatgccggccttcatcctggatgatccgcagaacaaagaaacacttcggcaatatgccgtcacgaaccctgcggacgctgaccggattcggccgctgtcaccgcttcacccggcctatgtcatttacacgtcgggatcaacaggtgtgccgaaaggtgtcatcattccgcacagcaatgttatccggctgtttgagtcgacgcggcattggtatcactttcattctgatgatgtatggacgatgtttcactcctacgctttcgatttctctgtctgggaaatatgggggccgctgcttcacggcggacgtctcgtcgtcgtgccgcatgacatcagcagatcgccggaagcgtttttacatctcctcgtgaaagagcgagtgaccgtacttaaccaaacgccgtcagcgttttaccagctgatgcatgcggaaaaagaacacaaagagcttgggcgtcagctcgcactcagatatatcatcttcggcggcgaggcgcttgagctgagccggcttgagggttggtacagccgccacgcggacaatcagccggtgctcgtgaacatgtacggcattacggaaacgacggtgcacgtcagttaccttgaattagacaaaaacattgccgaactgagagcaaacagcctcatcggctgcggcattcctgatctgaacgtatatgtgcttgatgaccggctggagcctgtgcctccgggcatcacgggtgaaatgtatgtggccggagggggcgtggcacgaggctacttagggcggcaaagtctgaccgccgaacgctttgtggctgatccgtacggcccgccgggaacgagaatgtaccggacgggggatttagcccgtctgcggacggacggttctcttgattatatgggcagggcggaccaccagattaaaatgcgcggcttccggattgaattgggagaaatcgaagcggttctcgtcaaacatccggatgtcgaggatgccgccgtagtcgtccgtgaagaccggctgggagataaacggctggccgcctaccttgtccgatctgccggcagcaccttggacactggggacatgcgccggtttgccgaagaaagcctgccggattacatgattccgtcagcttttgtccaaatgaatgaactgccgctgacaccgaatggaaagcttgaccgaaaagcgcttcctgcgcctgacttccaaacggaggtcaccggccggggaccgagaacgccgcaggaagaaatgctttgtgagctgttcgcagaggtgcttcatctgccgcgtgtcggtattgatgacagattttttgatttaggcggtcattctttgcttgcggttcatttaatgagccgtattcgggaagcgatgggagccgagctgagtatcggaacattatttgaagctcctacggtggcaagccttgctgaaagacttgagtcaggaacgggcgcaagcgcgcttgatgttcttcttccgctcagaacggcaggagaagaaacaccgttgttctgtgtccatccggccggcggtctcagctggtgttatgccgggctgatgtcttctttagaggctgattatccgatatacggcttacaggcgagaggcatcggaaaaaaagaatcgcttccgcaaagcctagatgacatggcggcggattatattgaaaaaatccgtaccgtgcagccgaaagggccgtaccgtctgctcggctggtctctcggagggaatgtcattcaggccatggcgacacaattacagagccggggtgaagaggtttcgcttttggtgatgcttgacgcgtatccgaatcattttctgccgataaaaaatgcgcctgatgacgaggaagccgtcatcgcgctgctcgccctgggagggtacgacccggacagcctcggggatcagccgcttgattttgacgccgcgctgaccattctccgccgtgagggaagcgcattagccagcctggacgagtcagtgatgatgaatctgaaagacacgtacattaattctgtcgggctgttaggaacatacaagccgaaaccgttccacggagatgtgctgttcttcagatcaacgattattccggagtggtttgacccaattgagccggatacttggaaaccgtatattacggggaaaatcgagcggtatgacttagactgccgccataaagatatgtgccagccgggcccgcttgccgacattggcgcgattctggcagagaaattaaacggacggcgtacagtccggtaaagaaaggaaagagatgatatgacaaatccatttgaacgggaagacggctcataccatgtgctcgtcaatgctgaaggccagtactcactgtggccggcctatctggatgtgccggacggctgggaaacccgcctcacgaatgaaacccgccccgtttgtctcgaatatattgaaacaaactggcgtgatatgaggccggaaagcctgaaacaggccgaagccgctaaaatgtaataagaaaagcctgccgttatttcggcaggctttttatgcggacatcagccgttaagctgtgtatgatcacaaaatgtataagggtggccttcttcatccgtgcaccatgactgagacagaaaagccaaaaagaccgcggcccactggtctgcaaactggattaaaataccgccgtcgtgccacgttccgttatccttcttccagcgtgtatcaattgggtttccctgattcatatgaatattatgcatgccgtttgtcggcttgaacccgaaaatcttatcagcgcccggctccggcccgaatttagagccgtaaatatagacggtggctttttctgatttggctttttgcatgtacgtctcaataaagtcatttaagtcattatccggaccggtgacttcatgcgggaggggcaccatgttccggggatcaaacaatccgccgcggacataatccagcgccagctcacggctggtttcatcaattggggtatatccatacggaatgttgggcagcagggtgatcgcgcttgcatcaaaatgatcgcgtgccgcatacagaacctctgattcttttgaacttgacatgacattgatcgcacagcgatagcgcgtatcaggctcgcctagcacctcgacttgaaaatgcggagcatcatcatctgtttcccttttcatatctgacacagtgccttttaatacaccatagtgctgaacagccatatgaatcctcctttttcttccgggatatgaattgatattcgagacagggggccgtttttccttttatgagaaagaaaaaaggacagcccgctgatcaggctgtcctcttcatatctattaagcttttgcagccgaaccttgcattgctttttcagcaggcacgtagtcatagcctaagtctttggctaccgcttcatacgtgacatgtccgttagccgtatttaagcccgctttaagcgcagggctgtctgcaatggcttgtgccgcgcctttattggcgatttgaagcgcgtaaggaacggtcacattcgttaatgcgagcgtagacgtacgcggtacggcgcccggcatattggcgacagcgtagtgcacgacgccgtgtttttcgtaagtcggattatcgtgggttgtaatatgatcaacggtttccacaatgccgccctgatcgatggcaacatcaacaatgacggaacccggtttcatttgtttaaccatttcttccgtaacgagagtcggcgctttggctcccgggatgagcacggcgcagatcagaagatccgcttccgcgacggaatctgcaatatttacagggtttgacatcaatgttttaatctgatgtccgaaaatatcatcaagctgacgcagtcggtctgcgttcaaatcgatcattgtcacatcggcaccgagtccgacagccattttcgcggcatttgttccgacgccgccccctccgatgatcgtgacttttccgcgggatacacccggtacgccggctaataaaattccttttccgccctttggtttttcaagaaactgagccccgatttgcgcggccattctgccggccacttcggacatcggcgtaagcagcggaagggaacgtccgtccgttaccgtttcgtacgcgatagctgtcacgcctttttctgtaagcgctttagctaattccggctctgcagctaaatgaaggtaagtgaataagaccagaccttgacggaaatacgcatactcttcagccagcggttcttttaccttcatgaccatttccgcatcccatacttgctttctgtcctccagaatttccgcccctgctgatacataatcttcatttgtaaagccgcttccgagtcccgctccggattccacaagaacccgatggccgtttccgataagctgtgaaacgcctccaggtgttaatgccactcgattttcattgtttttgatttcctttggaaccccgataatcatgtctgtttcccccaatgtttgtgtgatgcttcaagtgtagcgcgatttttgcgaaaattctttgtttgaaacagaaaataaaaaaacacggatttgtgaaatttcacgaacccatgctgcgaagtttgatatcaaggtaaatcgtaaacttttcattcacattttttaagtcgatttctgcgatctggctgattcttttcagcctgtaattcaatgtattgacatggatgttaagcgctttagcggcggtgttgacattgctgtcggcatcaataaaatgttcgagcgtttttaccatatcggcttggtgctccctgtcatactgctcaagctttgacagggaatagttcatatagccgctgtgcttgcgtttttcatccaacacatccaggtactgataaatgccgagttccgaaaagctgaaaaggtgtttggtttctctcacaaaccgctctttcgcttttaatacggaaagcgcttcctgataggagcggtaaacataagaaatcgattcgtaaataccgccgaccgcaatcgacgcatcctcaattttatatcgttccttcagctgtttttgaatatgaagggcgaagtgctttacatctttaaaaggctgatcggttttcggcgcggctaataagattaattcatttgaatcaacagtcgccagcatgacatgaatctgctgtgtcgtttcctgcaaatattgcagctgctgttccgtcttttcagtcagctcatcatgtaaacggatgatcatgacgctgaacacggacggcagcgccattccgagcttatgaaacccttcggccatttcggcttcctgataaatatggccggtcagcattttccaaaaaaactcctggccccgctcttcgattttcgttttgcggatctgcaggtgcaaaagtttgttccgcaccgctttggctgccagctgaagtgtcttcagatcttcgtcattgagcttttttttgatctcaagcgcccaaataaatccgagaacctgactgtttttccagatagaaatcgccacgcggttgctcaggcccacctcgtcaatttctttcactttgatcggctggtccgtttttaaaagggccggaatggttccgtctttccagagtttgttgatgactttttccggcaccctccgcccgataatcgtcgacgtccgggccggatctgtacaatcgctgtgcgtgctgtatgcaagcagtttatgattaacgtcttctattgtaatggggcattgaagaacttcactgatatggtcggcaacatcttcaagcctgtcgaaactgtacttaaatggatcctttggattggtcatctgtatccctactttttcatagcttcatatcttgatcttaccatcttgcttttcagactgaaaggcatctttgcagggaaatagactaggacaataagatcattcgatgaaaacgaaaataataagaaaatcatactactacatttacaaaatgtgtaaatataccgaaaaatccaatatatcataagactcattttgtaaaattaaaacagatttgtttgactgtgccgaatggttgtttttataataatgacgttcaaaaaataagtgaattagcccatatttaggctgatgacacaggagggtataaggaatatgtctggattaattcgtgtcacacccgaagagctaagagcgatggctaagcaatatggcgttgaaagtcaggaagtcatgaatcaggttgaccgcctgaaccgcatgatttctgatttgaaaggcatgtgggaaggtgcttcaagtgaagcctttgcagatcaatatgagcagctgaaaccttcatttattaaaatgtctgaattgcttcaagatgtgaatcatcagctcgatcaaacggcaaatacgcttgagtctactgaccaagatatcgctaaccaaattcgcggataataagatgaatgaagaaacggagcgcctgattcaatcaagaagacggcgctctttctatgtaagggtgatatgaatatgtatatcgatattacaatagatttaacacattataacggcagcgtcttcgatctcagattgtcagattaccattctgtgaaaaaagtcattgatattgcccggcaggctcagcatgtatccgttccgccgcgtgaaggctattggatcagagtggtcaataaagaagcggttttttccggagaacaaaagctatctgactgcggcattacgaacggagaccgccttgaaattttatgaaaggacatggtggaatgacaggtcataacagatcttatttagaaacagaattagacgccgtccgagaagaaaccgaatcaggcttcacgttcaccttccagcgggaaaaaatcaagcttcttgacgggctggaagcaaacgtgattaaagatgctgatcctttttttcaaaaagaggtctcagtttcagaagacgaagtaaccatcacaatcaaacctccttcttcttatcaggctttccgctatataaaaggaaaagataaaaaaagcaggtggcaatttgcctaccgtctcgtccaagccgtgaaacagcataagctgaaacgtctcaatctgattgccgcccctgaaaatatcgtgtttgataaagcgctgacgccttactttcttcattacggcgtaaaggagagccttccgccttatgaggaagatagagaaagggtgttaaaagagctcaaagcctgtgcggcgcttgcagctgacggggcgtacaccttcgatgaatatttgaagtacaaggagacgcttcacttctctcctgaggtgaaaagcgtgctagaggcggagacgattgaagaactggaagaaaccattcaaaccgcaattgattccctcgaagaaagagacaagacatacataaaactgccgaaaaagaaatggaaaatccaaagatacgccggtctggcgcttgccgtcctccttgtgccgacacttctttactccttatacgttctgtttttcgcccagccaaagcaagaggcaattacggaaagcaaccgctattttttaaatcagcagtacagcaaagtcattgacacactcgccaaatacgatgcggaaagcctcccggaatctgtgcagtacgagcttgcttcttcttatgtggcagttgaaaatctgagggaagagcagcggaaaaacatcgggaatctggtcacgctgcaatcagacccgaagcatttcctttattggattgatatcggcagaggggaaaatgaagaagccatcaaaatcggccgcaatcttgagtacaacccgtacatctggctcggacttacaaaatataaacagcaattattagcggatgacagtatgaaagacgacgaaaagcagaaagaactggacgccgtggaaagcgagcttgcgaaggcgaaaaaagaggcggaggagcagcataaagaagcggaggaaaacggtgacaccgccgaagcttccgccggacaggatgaaagcaaacaagacaaagcgaaagataacaaagagaacgacaagaaagatgagaaaaaagatgaaaaaaaataacagcacacatcaaatggccgcaggtaacgatcaggctgtcaggaggttcgccatatgagtctgttatgggtcttttaccgagagcacgtacaaaagattcagctgtctgaactcccgccgtctcagccgattacgatcggtccggatatgaaagatacaatcacggtcggcacacttccgttacggcaaaacgccgcaaccctttatcgaaaagaaacagatcgttatgatgttttcctgggaaataactgtgccggcgaattgacaataggaaatgaaatgccctgccggattgaagaagagacgatgcggcttctgctcacccctgacaaagaagaatcctccgtttattttatcggcgggaaggatgagatcgttttctcatcagaaacagaggaagcggatatatacaaagagccgtcctccgctcaaacaggggctttttatctgcgaaagtcgggaggatgctggtctgtcatccctgatggccaggacgtttatgtgaacggaaaacttgcagaagctcctgaaaggctccgcacgggagatgagctgctgtggaattttctgcgtgtgaggctgacggaggacgaccttttagaaatcgttcatcacgaaaagcttcaaaccggtttaaccaaaacggtaaaaccaagcaccgaaatgaaaaagaaatacccgcaatatcgaagaacgccgcgtatggtctacgatcttccagaagaccgcgtttcattcagctttccctcgcaggaaagcgaacagaataaccgggggctgtggctcgtcattctgcctcctttggtcatgctgattgtaatgggggttgtcgccattatacagccgaggggcatattcatccttgtctctttggcgatgtttatgatgactctcattacgtccaccgtgcagtatttccgtgaaaaaaaccagcggaaaaaacgggaggaaaaacgggagcgtgtgtacaagcagtatttagaaagcaagcggaaagagcttcagacgctgtcggaaaaacagctgcaagtgctgacgcatcattttcccccgtttgaaaaaatgaaatatttaacttctgaaatcagcggccgcatttgggagaaatcgctggaaagcagggattttctgatgcttcggctcggaacgggcacggtcccggcaagctacgagatttcaatgagcggcggagaccttgcgaaccgtgatgtggatgacttgatggagcagtcgcagcacatgcagcgtgtgtataaagatatccgccatgcgcccgtgaccgttgatttacaagaagggccgatggggcttgtcgggaaacctcagatcgtcaaaaatgaaattcaccagctgatcggccagctcgcgttcttcaacagctaccatgatctgcgatttgtctttatctttcatgaggacgaatataaggaatgggaatggatgaagtggctgccgcaatttcagctgcctcatatgtacgcgaaaggatttatttacaatgaacagacccgcgatcaattgttatcgtccatttacgagctgctgcgggagcgggatttggaagaagataaagaaaagaagatcttccagccgcattttgtctttgtcatcacaaatcagcagctgatcgcagagcacgtcattttagaatacatcgaaggccggcatgagcatctcggcatctcggcaatcattgccgcggaaacgaaggaaagcctggcagaaaacattcacaccctcgtccgctacattaatgaagatgagggagacattctcattcagcagaaaaaagcggtgcagatcccgtttaagctggacaggcatgaacggacaaacaacgagcggttttcccggacgcttcggacattgcaccatcaggtcggaatgacgaattccattcctgaaacggtctcatttctggagctgtttcatgcgaaggaagtaaaagaaatcggcatcagacagaagtgggagacaagtgagtctgcaaaatcgctggctgttccgatcggctataaaggaaaagacgacatcgtctatttaaacctgcatgaaaaagcgcacgggccgcacggattgctggcgggaacgaccggctccgggaaaagtgaatttctgcaaacgtacatcctgtcattggccgttcatttccacccgcatgaagcggcgtttttgctgattgactataagggcggaggaatggcccagccgttccgcaagatgccgcaccttctcgggaccatcacgaatattgaaggaagcagaaacttcagtatcagggcgcttgcatccattaagagcgagctgaaaaaacggcagcggctgtttgatcaatatcgcgtcaatcacatcaatgactatacaaagctgtataaacagggagaaacggatattccgatgccgcacctgtttttgatttcagatgaattcgccgagctgaaaagcgaagagcctgactttatcagggagcttgtcagcgcggcccgcatcggacggagccttggtgtgcatttaattctcgccacgcaaaagccgggcggcatcattgacgaccaaatatggagcaactcacgctttaaggtcgcgctgaaagtgcaggatgcaagtgacagtaaagaaatcctgaaaaacagtgatgcggcgaatattacggtcaccggacgcggctacttgcaagtcggaaataacgaagtgtatgagcagttccagtctgcctggagcggcgccccttacatggaagatgtatacggcaccgaggatgacattgccatcgttaccgacaccggcttaattccgctgtctgaggtggacgcggatgatgcggcgaaaaaagacgccccggcagaaatagaagccgtagtcgaagaaatcgagcggattcaaaatgaaatgggcattgaaaagctgccaagcccgtggcttccgccgcttgccgaacgtatcccgcgcacgctttaccccgcgcaggaaaaagaccgcttcttcatcgcctgcgttgatgagcctgatcagcaaagacaggcgcctctcgcttatacgatgatggatgacggcaacatcggcattttcggctcatccggctacggcaagtcagtggctgccatcaccttcctgatgaacttcgcggaaggatacacgccggaagagcttcatatgtacatctttgacttcggaaacggcacacttctgccattggcaaagcttccgcacaccgcagactatttcttaatggatcaaatgagaaagatcgaaaaattcatgatccgcatcaaggaagaaatcgagcggcggaaacggctgttcagagaaaaagaagtcagccatatcaaaatgtacaattcgctcagtgaagaagagctgccgtttatatttatcacaattgacaatttcgacatcgtaaaagatgaaatgcatgaattagaaacggaatttatccagatttcacgcgacgggcaaagcttaggcatttacttcctgctgaccgcaacgagggtaaacgccgtccgccagtcgctgttaaacaacataaaaacgaaagtcgtccattatttaatggatcagtcagaaggatactccatttacgggcgtccgccgttcagtctcgaaccgatcccgggccgcgtgatgatccaaaaagaagaactgtatttcgcgcaaatgtttcttccggctgaagcggaaaatgacctcgagatgttccaggcgctgaaagccgatgtcaaagcattagctgagcgccacgccggaacagccggcccagacccgattccgatgcttccggataggctgacggccggcgaattttcactccgtctcggcccggatcaagagccgttccgcattcctgtcgggcttcatgaggaaaaggtcagccctgtgtactttgatctgggcaaaaataagcattgccttatcttaggccagacacagcgtggaaaaacaaacatcctgaaagtgatgctgaatcacctgctgcgtgaaggtacggaacgggtcgggctgtttgactcgattgaccgcggactgtcgcagtatgcgcaggaaacaaaggtcagctatctggacacaaaagaagacgtccggcagtggatcgaaacggcagaagccattttcacggagcgcgaagctcagtatgcgcaggccgtcaaaaatggcgatgtgtacaaactcagtttctctccggtcgtgttaatggccgacggcattacaagattccagcagacgatcgacaccgccattcaggacaagctggcgatgtttatgaaatcttacgcgcatgtgggcttcagttttatcccagcgggcaatcacagcgaattctcaaaaggttatgattccttaacgacggaaatgaaacagatccgccacgcgatgctgcttgtgaaaaaatccgaacaaaatgtcattccgctgccttaccaaaggcaggaaccggacattcagccgggcttcggctatttggttgaaaacgggaaagagcaaaaaatccaaatacctttatgttcagcggaaagggaggccgtcagatgactgaacaacgaaaaagcctgatcaaattaatagccgcggtcgtcatcattctgctgctgccggtgctgtttttccggtttatcggcgatgacccgggaaaacaaaaaatcaacgccacccgccaaatcgcagtcgtgaatgaagacatgggcttacaaacagatgaaaatgaggaagaggaatccgtccatttcggcaaagaagtagcggccgctctcggcggccgtccggattattcatggacggttgtcaacaggagcgcggctgaaaacggtctggcggctaagaagtatgacgccgtcgtttacattccatccgatttttcaaaagatatcttaagctatgacaaggagcgtccgcaaaaagccacgctgacattcaatattcaaagcaacctgaacgccgtcaacaaagaaaaggtgcagcgtgagctagaagacgcccaaaaatcaatgaataaaaaaatgtcggcattatattggaatttcgtctcgcaaaaagtgaacaatgtccgaggcgattttgacaagatcgtcaataaagaatcagagtttcaaaacgtcatgtacaacttttacaagccgagctccaatgacttggcaggtgaaatcaagcggcaaaaagacctgattgacgaactgaaaaaatcaatgaatgaagcgcagggcgcggcaaaagaaaaattgacctcggcagatgaagccaaaaccacgctcaaagactttgccgatacggtcgagcgctataaacaatatcaagaaaatcagaaaaaactgctgatggtcgcgcaggaacaaaatcaaaagcaaatcacaaccggactgaatgccattaaagcacagcaggccgccaaccagttcagcacgatgatgagcggactgtcctccggcataaaccgggcgcagacacagcttgaccagacgggatcggctctttctgccgcccaacaggtgagagaagcgcaggttcctgatcaggaacgcgggatggcgaatattcaatccaatttactggacaattatttgactcaatataaagctcaagcaagatttgaaacactgaacagtatccaaacccttatgaaaagggatcggccggcattaaccgttccggaaaaggacccgggtgatgacggctcggatgaaccgaaagaagaagaaaaaccggaagaagaaaaacccggcgatctgaaaattgaccttgacgatcagcgtgacgagttaaaacgcatctccgctgaaatcaatcacatttctgaaggattaaaagaaccggaaaaagaaaatccggcccctgaaaaaccgggccaaggcgatgacggtgaaaactccggcgataccgatccgaataacggaacaaatcccggagaagacggaaaaacggaagacggcacaaaagaagagcagcctgcttcccataacacaggcgatcaggagccaaaaaccgtccagaccgcgacagccgctaaaaacgtcactccgcctgctgatgagccggcggacgacccgaacgattctgaaggggacggcggcacggacatatctgaggcgaaagaaaggctgaaccaagccgcagagcggattcagcaaattgaaaaagagctggaagagaaacagcagactcataatgaagaactgaaaaaacgtctcgatgctcttgatgaagaaatccaaggccttcaagaccagattgatgacgtcaaaaaacgtgcaaagaaaaagctagaggaattgaaagaaacgagaaaacaagacttcaataccgtttacagattgattgtaagaacagaacagaacattttgaactacccgtcattggatagcggccgcaaatctgctcttgaacagatatttgccgctgacatcaatacaaaagtgatatccgatttaatgagttactataatgatttatccctgtatgaggcgacactctatcactctcttgacgcgggctcgctgcctgatgtgaaaaacagggtgctgaaagctcagcaaggcgaagtccaaaccgttctcgccatcaaaccggaagaaacggcaagctgggaaaatctaaaaaacaacaaaatgcagacagatgaagacatcagcaatttcattaaaggcatgaccgaattctcggataactacagctcgtatatcagagatgaacaagccggagtgctcgatgagctcgccagcatttcagacagcgcggcgaaagcatccgatcagctggctgaaggcgccgtgcaggaagcggccgcgttcagcggagacggattaaccggaacgatggcgctcggcgctcaggataccgtcggccgcgaagtcctgcaaatgtctgacacgatgggccatctgtcagaacgccagtccggcatcatcagctataccgacaatatgcagcaaagcgtaaatgatgtccagcataaagcggacaccctgaacagcaactggggcaaaaacgtcgattccacgaaattgatcagaaatgacgtgtacggcattttagggaacgcgctcgttgacggacaggaaaacggctatgtttacgattatctcgccaacccgcttaaaatcagtggagaggtgccggaagaccgggttcagaatgttccgccggtcgtcattttggtgatcgtcctgatcagcagtcttctgatcggctatttcagctcgtattatcagcaggcgccgcttcttgtcaaaggcgcgctctttgggattttaaacattatggtcggattgatgatcagtctgttcggtctgaatatctactcgcttccggacgatcagacgattaaatggtcagtctttacgattctcttgcttgcggcgagttcagcttttatccgggcagcctttgtcttcagctcaatcaccggatggattgcatcatccgcgctcattctcttttatgtggcgcctttgatcgacctgattatgccgaacttcacctttgacagtccggtttcgaaagtctatatcgatattcaatacggaacgggccatctgtttgcgatgggggtaacggttcttgcgatcattacgctgattgcggcggcgcttccgctcgtcattcggctgtttgcggaaaaaacggaggaaagtgatcagtcttatgaggcgtaacacgttcatggaaaaaggattgctgctgtttgctctctcctttttccttttccttccccaagccgcagccgcgaatgaggaaaatactgatgtcaagccgaatgaatatgaaaagaaagacattgaaattcgtacggattacctgcacgacgatgcctactccgaggaaaaaacggcgcttccgaaagaacagaaggatattacctttgatcagccggccgaaaacccggatgacaaactgatatcaaagttgtttacatcgtcagacacggagccgaatacgatcaaagcgcaatcgaaaaaactgggtatcacatttgccgagcctgcggtgcggcatacctcggcagatatggaaacggaggagaaaaagacttcttatctgctgcctgtcatttatgccgtcttgatcctcctcgggattgcggcgatgatctatttgatcccgaaagtcacggcgcaggaaaaggcaaagcggtaaacggatcgcttgtgtttgcgggaagacagcccgtaaaataagaaaaaaaggaggagtttcatgcagttttttcttataacaggcgcgtcaaaaggcttgggccgggcgctgacggaacaggcgctgcaagaaggagccgaagtcgccgcgctttcaagaacgataagcggggaaaagcgtgaggggctgacagaatacagtgttgatttaaccgatctggcagatacagagcggcagatgaaggcgattcttgatcaagcagaggagaaggggtactccgccgtcacactgatcaacaatgccggaatggtggaaccgatcaagcgggcgaaagaggcttccgccgaagaattgaaccgccattacacccttaatctgacggcgcccgttttgctcagccaaatgttcacaaagcgtttcgaagcgttcagcggcagcaaaacaattgtcaacatcacatctggcgcggcgaaaaatccttataaaggatggagcgcgtattgcagctcaaaagcggggcttgatatgtttacgagaacatttgggtttgaacaggaagatgaagagctgccggtccgcatgatctcattctcgccgggagtgatggatacagacatgcaggccgtcatccgttcttcgtcaaaagaagatttccatgacatcgagcggttccgcaatctgaaagaaacgaaaaacctcagaagtcctgaatacatcgccggcgtcattcactcactgatcgcgggcgagccggaaaacggacggatatacgatatcaaagaatttttgtagagcagcttttacgctgctcttttttgtttgtacaatcacttcggggtccggcggcatatgatgaatgaaacaacgtataaggggtataagaaatgtatcagatgaattgagtttcttctcgatttatgttaggattctaaaaatataaataaggaggggtttccatgagaaatgtaacgttaatggatgtcttcacccatccaatcgcacaaaagtatttacagcgttccggtgtcgcccatgcgatcgcctgcgcgtttcatgcataccgtcttgccgtaaaagcaggtgtcagcccggatcttgcggcgaaagcggctttactgcatgacgtcggccattatgaatggtacacagacggcaaatgggattatgaaaagtacagaagaaacgatatccatgccattaaaggcgcggaacgggcgcataagctgctcatccggctcggtgaagaaccgaaagcggcgaaggacattgcgctggcgattctgcttcacaccgattcctatctgcccgaaggcgaactggacaagaatacgctccagcaaatcgtgaaacaagcggatgaactcgatgaagaacccggcgggcatcaccattaccgccaaatggatcacacggccgcgctcaaacaaatccaaaagcttgatcagttaattgaccaagcccaatatcccataagaagctcagtctaggccactcatgcggccttttccgcttacataactccgcatgctcactaacaccttttccgctccgatagacgtactgtgtcaaagcctttgtccgctgcatatgctgaaggaaaacatagtaaaggggatcagcgaaaatggcccatcaaggaagcccgcaaatcgtctcgttagtggacccttacgtttatcagaccatccataaacttatcggctcaaggtttatcattcaaaccgtcagacgcattgtcagaggacggctgattgatgccactccggatcacatcgccattgaagaaacgcatgaccgtgtattttatatcagaaaccgccatgtggtttccgtcatgcctgattataccgaacgcgtgtaacagcccgaataaggcgcaaaccggaggcggccctatagaaccccggtgcgtcttcttttttgagatacatagatgcacggcggctttttttggtacaatcacagtacaagttcacatgacaataggaggaaaccgcttgttgaaatcaaaggtccatttttggacgctgcaaattttgctcgttttgctcattatttacgtatcaacgaaagtttcgtttatttttcagccgtttttcggttttatcaccactctgttttttccgattttgatctcgggcattttgtttttcatttttaatccgatcgtacgcctgcttgagaaaaaaatcccccggacattggcgatcctgctcatttatctcgttttcatcggcctgattgcctttatgttcaccgccatcggaccgattgtggcttcccaggtcacggggctgattaacaatttccctgattacattcatcagattcaagtcttgacggcgcaattatcccattccaaatggtttacgtggatgatgacgcaggattatgtgtcgatagaaaaaatccagcagtctctgacgggatttttacaaagccttccgcaaaatattacggcaagcctgtcggccgtgttcggcgtcgttacgaatatcacgcttgtcgtgatcaccgttccgttcattttgttttatatgctgaaggacggccggcggtttccgctcttggcggttaaaatcctgcctacttcctaccgggcggaaggtcgcaaaatatttaatgacttatatgtcacattggccgcctatttccaaggccagctgctgatttgtctctttgtcggaacggcatgctttatcggatattggatcatcggcctgcagtatgcgttaattctcgggatggtgatcgccgtcaccaatatcattccgtacctggggccgtttctcggggcggcgcccgcggtgattatcgcgtttatggattcgccggctaaggcgctgtttgccgttattgttgtcgttgtcgtccagcagcttgacgggaacctgctttctccgcttgtcatcgggaaacggctgaatacccacccgctcaccattattcttctgcttatcggagcgggcagtttcggcggcattctcgcaatgattctggccgtgccggtttacgcggttttaaaagctttcgtcttaaatatcgtccggcttatcaaacttcgtcagcggtcaaagctagaagacagccgcaagccgaaataaaaacgggcacaactcccgatgcagcgcataaaatgctgtaaagaaaagcggaggtgcgggtatgcctgcaattgtgggaccgatttatattatgagtttagccggagacgctgcggcgagcttcggtgacgtgtttgccatttctcccaaagccgttgaccactcaggcgcgggggcaggggcgtttcattccggagattttgtcaaagtcactaataaattcagcaaaacgcgctttgaagacatcgatgtgtttgacgaacctgattggtttaacgcgtgacagcctccttttaggaggctgtcgcttttttgtagtataatagaatcagtctttataaaaggggaattttttatgaaaatcagaaaagcgaatattaccgtgcagtccggaatgatcggtgatgtatatctgcatgaaaataaaaaagaacagcatacccttgtagccgttccggaacttgagtggagcacgatcatttcctatgaggaagagaaaaaggcgctggcgcagcggcttttacaatcattcagcaagctgattgaagaagaacccgccggagagctcgccggcaagatctcccattgggtggctgaaatgtaacgaagcggtttaccgcgtcccgtccggggagataattgtaaaacaagctgaggagggacaggccgatgagcgacaaaacggttgacctttatttacagcaggggatgtacggccctctgcagacgaaaccggatgaacgccatttatttttaggctcgctgcgtgaaagagtcatcattgccctgacgaaggggcaggtgctgcaaaagcagccgtatgaagaagtgaaacaggcgctgaaaagccgaaaagacgcggtgctctatataaacggaaggctcccgtatcatgcttattcaccatatatgaagcttgccgcacttgccggtgtccgaagctccgtcatatcggatcttcaattcgaaacgccgctcggcctggtttttgccgccgattatgccgtgaaccttgacggcatttacgtacaggatgacatttttcagcgctcactcctgaaatcttaaaagggcaaaacaccgtttgtcattttacaatgccaattcacttacaagtggagataggatataatggttttcatatgaatggcggggaggccggctatgaaaaaagcatttatatgcattgattatacgaatgattttgcagcagagaacggggcattaacctgcggagaacccgcgagacagattgaagatacgattgtcagtttgacgcaagcatttatagaaaacggtgattacgttgtctttgcggtagattcgcatgatgcagacgatgactttcatcccgagacacgcctttttcctccgcataatatcaacggcacggagggcaaagagctgtacggaaggctatcgcctctttatgagaaacataaacacgcaaaaaacgtaaattatatggaaaaaacgagatattctgcttttgcgggaacggatttagagctgaaactgcgggaacggcagatcactgagctgcatcttgcgggcctgtgcacggacatctgcgttcttcacacggcggttgacgcctacaacaagggctttcagattgtcattcatcaaaacgctgtggccagctttaatccggaagggcatgaatgggccctgtcccattttaagaacagcatcggagcgcaagtggcagagtaaggaaggggaaaataattttggtggagcatggttttaaagacgacagtttgtctttacatacagatctttatcaaattaatatggccgaaacgtattggagagacggcattcatgagaaaaaagcgatttttgagctttttttcagaaagcttccctttgaaaacggctatgcggtatttgcgggcttagaaaaagcaatcgaatacttggagaacttcaaatttaccgacagcgatctgaattatttaaaaacggaattgcactatgctgatgatttcattgagtatttacgggatctttcttttaccggatctctttacagcatgaaagaaggcgagctcgtttttaacaacgaaccgattatgcgggtcgaagcgcccctgatcgaagcccagctgattgagacggctctgcttaacattgtgaattaccaaacattaatcgccacgaaagcggcccgcattaaaggcgttgtcggtgacgaagacgccctcgaattcggaacgcggcgtgcccatgaaatggatgcggctatgtggggagcgagagcggctctgatcggcggcttcagcgcgacgagtaatgtaagagccggaaagcgttttaatatacccgtatccggcacgcacgctcatgcgctcgtacaagcgtaccgcgatgaatatacggcatttaagaaatatgcggagacccacaaagactgcgtgtttctcgtagatacgtacgatacgatccgttcgggcatgccgaatgcgattaaagtcgcaaaggaattcggcgaccggatcaacttcatcggcatccggctggatagcggggacttggcgtacctttcaaaaaaagcgcgtgaaatgcttgatgaagcgggtttcacagacgcaaaggtcattgcttcaagcgatcttgacgagcacacgatattaaatctgaaatcgcaaggagcgaaaatcgatacgtggggcatcggcacgaagctgattaccgcatacgatcagccggccctcggcgcggtttacaagcttgtcgccattgaagaggacggcaaactgactgacaccattaaaatttcgtcaaaccctgaaaaagtgacaacgccgggaagaaagagagtataccggattatcaacaagctgaatcaccactcggaaggtgattatatcgcgctttatgacgagcgggtaaatgatcagaaacgcttaaaaatgttccatcccgtccacacgttcgtcagcaaattcgtcactgatttctatgcgaaagacttgcatgagccgatttttgaaaacggcgttttatgctatgataatcccgaaattaccgacatccagcaatacgtgcaggataacctcaaacttctgtgggaggaatacaaacggatcagcaagccggaagaatatccggtcgatttaagcgaagactgctggagcaacaagatgcagcggattcatgaaatcaaaagcgagctgaaacgggaacttgaatagaagacaaagcggcctttcctttctctggaaaggcctttttgttgtgataatatttttcacatttagacaaatttcgtcaagttatttgatatacttatgttcgaaggccgcatctaagggggtaaatgaatgaaggtgtttgttgcgagacagcctatcttcaacagaaacgaacaggttgttgcttatgaacttctttaccgggagagcgaagagaaccgttattcggccgctgatggagataaagctacgacggatctcattattaacagctttatcaacatcggaatcgaaaagctgactgaggggaaacgctgctttgtgaattttacagaaagcctgatgttttcagatctccctacctcctttgatcctgaccagcttattatcgaaattcttgaggacataccgatcactccggcactcatctcaagatgcagacagctgaagaaattaggatatacattagcacttgatgatttttacgccatcaatccggaaaatgaagagttagtggaacagctgatgaaatatattgatattttaaaaatcgactttttgcaatcctcgcgtctggagcgcaaaaaaatcattcagacgtacagctgtaaaagtctgatttatttagcggagaaagtggagacgagaaaagattataaacaggcggccatagacggctttcacctgtttcaaggatattttttcagtgaaccgcgtgtcatcagcggaaatgatctgacgtttcattttcattcttactaccagcttttaagcgaattaaacaatgaccagcccaatatacagcgcgtgacggaatacatagagcgggacgtcagcttatcgtatcagattctgcgttttttaaacggatcgcaaacaaggctgaaaaaaaagatagacagcatccagcaggccatcatgatgcttgggctgaatgagattaagcgcttgatttacattctttcattcagagatttaacggcgaaaagccactcaagccaaaaagaaatcattaagatttccttaatcagggccaaactgtgcgaactgctggcgaaaagaaccggaaggccccagccctcttcttacatgctgatcggcatgttttcgctcatcgatacgcttctccacagggagctggaggatatcatcaaagaactgcctttaatcgatgaagtcggacaggcgctgctcggttatgaaaacgattattataagatgctcgcgttcgtcaaagccattgaatgcaacaactgggactgtgacgagtggggaaaagaactgaacaaagaagaagcgtatgaatgttacttacaggcgatcgaatggtgccggcagctgatcgtggattgagccgctttaagccgaccacctgagggcgatggtaaaccggctttgctctctgatcagactgacacggatgccgtcgggattatacgtcacgtcaaagtcatttttgatgccggtctgcttaatgagccgcttgaccgctgcggtgtcagatgattgcgctgcggtgaggatacggcgcgcaagctcttttgacgccgacagccgcgcaaggagcaggcgcgcttcctccagcatgcccgcagcctcttttgcggacgctgtcaaaatatctgcgtgaaccggggcactgggcgcaggatgccggtatggcgcggcgaaaacaggaaagcatggatacacataatgcatacggcggcctccttcctgagaaaacattcgttatacatgagtataggcggcatgataacgagttatgacatgcaaaagaccacaatgcgggggttgcggtcttttcggtgtttgtcggtggttatgcgacgctgttcgcccattctgttttgaaattgcgacggcagggactatagtccttgccggtttgtcggaaaaccgttaaaaaaacagcagaaccgccagattggtctgcttcatcctaaacgtctgcctttctggtagttatatagtcctgttcgctaaatgctccattcgggactataggattaccccggtttgcggtgtcacgcagatacttttacacatacttttcggtgaaaaatcccgcaaaaacgtttacactattagtaacagatcaaatacctaggactcgttcaccatacacaattcattgatctttcaaaaaaaggagtgtggaaacggtggaaaacaaattagaagaagtaaagcaattattattccgacttgaaaatgatatcagagaaacaaccgactcattacgaaacattaacaaaagcattgatcagctcgataaattctcatatgcaatgaaaatttcttaaaaagacttggaaacaagtcttttttttgtgcattttttatccatttcgtggataaagtattatacgattgttaaaaaacgaaaaacctgctgtctttcatcacctgcatttagtaaaatagaatgggagggtgaagacaattattgagcaaatgtgtttagatgccgaaacgattaaagagaagatgaaggaaattgtggagcacaatatatgcaatactaacttgaaaatgtaccttctaaaatttattgcatcaaaagattcattcggatttgctgaattggcatatcaacattacaaagcgttcaatggcagagacacagaggcaattttaaagttagccgtaggcatagaattattagtcctgtcatacgacatttatgatgatttagaagataatgataatctgaaaatggaatggatgaaaacaggtctccccattacgctgaatactgtaacggccctctatacattaagtatacaggttatgaatcagattagtgaaaatccgtattttcttaagcaaatattaaactttgctttgaattcaattgagggccagcaagatgatattttgaatgcaccgcaaactgaagaagagtgcttgaaaatgattaagaataaatctggctctttaactgcaatgccttgcgttatgggcgcgatgctggctacaggaaagttaaatccaatcgttcaatcatattcatatgaactcggaataatatcccagattgataatgattatcaaggtttgttttacttgaataatgattttgttcaacgcaaaaatacacttgcttatttatacttaaaaaagagattcaataaagcttctgaagaaatcttacaatggtatgaaaacccggagttattcaaaaccttaaagactcgagacataaaaaagaaattaattgaagcaggtgtaacccaatacttattggttttgaaacatttgtcgttaaaaaaaataaaaagtaagatatttgaattggaaatagaaagaaataaaacggaaactttattaaatgcgattgttaatttagaggaggatgaaaaataatgcaggaaattgtaggatacttaaccaaaaatccagaagttttaaataaagtgattgaaggcaatgctagtctgattggagttagccaggatcaaacagattgtgttataaatgcgtttaagggtatagatgttatttctttcggcggtgattggaaatattgaggatgatataaatgaagtccaagtacaataagatttcagttgtcttaattctgcttacattggtatatgtcatttatctgacttatataagcacaaataatcttttagtcggcgccacaatttctgaaaataaacagggcgaaattaaaataaaagatgtagaagattttacaatggcatattacgccggagtgcaaaagggagatatagtaaagaatattaaccaccaaaatgtaaagtcaattaatattcaaatgaataagctgaaaaatgtaaactcgatggtcgttgatagaaacggtcatgatattgagattaagctcaatttatttaatgataggaacttcagtacttacttaataccgataattttttatgtagtatgtttattttgctgtttcttcatcatcaaaataaatgaagaaaaaaacttgaaatctgctttggtgctaattgtatttcttttgtctgcttcaatcgcatatattagtgctggaggatcggcaaaaggcgatttgcttagcagatgcatcatgttgttaacattaataactgtacctttaaattatcttctgtttctttatcattactttaaagaattaggtacagtgcttttcagcaaaaaagttttcgctttgtatttatttccaactataaatatattatttgaattattccggtcgcgattatcttttggtgattttattccaaaatttaatttgatttcgttttttcttctttttttgattgtagcatattactttattgttattttgagaagaaacaaagatactgatcaggcacatattataaaggtgcttgtggttataaatatattggcattttcgccttttttatgtctgtatcttataccgtatgtattttttaatgattattatgtctcttctttcttaacagcatcatttatgctgctgatacctttttcacttgtatatcaattcatgtcgaataaaatatataacgttgattttatcttaagtaagttaaaatattacggctttttagcgttaaccccaactataattctggttacgacaatagagttattacgtgagccggaagaaaatttttacaatctcaaactgacatttttaatttatattttaatgttagctgttttttattataaagaaatactcgatttccggtttaaattaaaaagggtttctgaaaggttcaattaccaagacagtatttataagtttacccaattaatcagaaactcgtcttctttaactcaggtttttggagaattaaaaaccaccattctcgaagtaactcttacaagtaaagtgtatatatttgaagttacgtatgatgggaatgtaaaggcatttgacgaaagagattcaagtttgatagatgattatcaagtgcttttaaatagtactggtgaaataggaaaaataacggagtttaatcaaggtttcgcaatgaaagtaggagaacggggagatagatcattcgttgttctctgtttgtctaagatgaatacgccccgtttatcacgtgaagaaatttcttggttaaaaacattatctttttacgttaatgtttcaatagaaaacgtgatgaaaatcgaagaacttatgaatcatctcgaagatttaaagaaacaagagacaaacccggtctggctcaaaaagctgatgtttacgatcgaggaaaagcagcgttcggatttggcccgtgatctgcatgattcagtgctgcaggacttgatttctttgaagcgccagtgtgagctgtttctggccgattttaagaaagaagagccttgccagttagaggtgcaggacaagcttcatcagatgaatgagcagatgtcggatgtcattttgatgacccgggagacgtgccatgagctgcgtcctcagctgctgtatgatttgggtctggtcaaggcggtatccaagcttgccgcgcagcagcaggagcgtgcgccgtttcatatccgtctgaatacgggccggtttacggcggcgctggatttggatacgcagctgaatttgtaccgcattattcaggaatttctttcgaacgccatgaagcattcacaggcgaatgaggtgctgattatgctgatcagcattcaaaataaagtgattctgcattatgaagacgacggtgtcggctgcaatcaggaaaaaggcggcggccagtcgatgagcatgggtctttcgggtattaaggagcgcgtccgtgcgcttgacggacggatgaaaatcgacacaagtgaaggaaacggttttaaagtagatattgaaatggaattgtaaccaatttatcaccaaatcgacttggcagaagccaagtctttttaataaaatggaaatgagtgagtaaaagggaggaaaccatgaaaaagatactagtgattgatgatcatccagctgtcatggagggcaccaagacgattctggaaacggacacgaatctttctgtcgattgcctcagtcctgatgccagtgaacaattcgttctccggcatgatttttcagcttacgatctcatattaatggatttaaatctgggtgatgacatcagcggcatagagctttctaagaaaatcttaaaagagaatcctctctgtaaaatcattgtctacacaggctatgaggttgaagattattttgaagaatccatccgcgcgggcctgcatggcgccatcagcaaaaccgaatctaaagagaaaatcatgcaatacatatatcacgtgctcaacggacagattttagttgatttctcctatttcaaacagctgatgacccagcaaaaaacaaaaacgtcttcttcccctcaaagtgagcaggatcggttaaccccgagagagcgccatattctccaagaggtcgaaaaaggtttgaccaatcaggaaatcgcagatgcacttcacttaagcaagcggtcaattgaatacagcctgacatccatttttaacaagctgaatgtcggctcccgcactgaagcggtgctgatcgccaagtcagataacgtactataaatcttgaagggagaatgacctatgaatctgaacaatacattgctcggcgcactcggtattgaaatcactgaaaacacaccggagagatgcgtggcggtgatgccggtggataagaggacggtgcagcctttcggatatctgcatggtggcgcgtcagcagcgctggcggagactgttgcaagtgtcggggcccagcattttatcgaccggtcgaaccaggcgtgtgtcgggcttgagattaatgccaatcatttaaaatccgtgaaagagggcgggacggtcacggcgattgcgaaacccgttcacacaggcagggcaaccattgtgtacgggattaacattttcgatgaacgggaaaggctgatctgtgtttcccgctgcacgctggctgttataacaaaataaacaaacagccggaaccctgaatcgtccggctgtttgtttttacaaatatgaatcttctttacgtttgatcacaaagtttctgatccctttgtaatcatcctgaacgcttcttttatcaagcgccgctcccgaattgtacgcggccctgcatatgaggtgcgctccgaccggcgccgtcagcaggataaaaatgatgccgagcagtatttttacagaaatttctccggtcagcatccacaagtagcctaacaccccgagcaataccaaattaacgccgagtgtcgagccttttgaagaggcgtgggcgcgcgtatacacatcaggaagcctgagtgtgccgaaagacgcgaccaggcagatcagcgatcccatcagaatacaaacggcgacggcccatttaacgatttcgatcattttcgataatctctcctttctccaaaaacttagcaaaggcaatcgtgccgataaacgataaaatgccgagcagcagaatgatgtccaaaaaggccgatgtgtttaagagaatggatacaagcgcggtcatggcaatcagattaatgccgatcccatcaagcgcgacgacccggtccggtatcgtaggcccttttatgacgcgaatgacgtacagaagagtcgaaaccgccataatgccgagtgataattgcagaataaacgtaaacatcagcggctcacctcctgaatggctttctcaaaagagacgcggatgtcatggatcgctttctccgcatcttcaatgtccatggcgtgtatatagagaatcgaccggtcatcggagatatccatcacgagcgtacccggtgttaaagtgattaacagcgagagcagcgtgatctcccaatcctccgtcaattccgtcttaaacgcgaaaatgcccgggcggatgttcagtttcggcgatataacggttttcagcacgctgacattggccaaatataattcctttataaagatcagcgccagtttgatgactgaccatattttccaaatataaaacggccgcgagaagaagcgccggaaaaaaaacagcgccgccaagcccgcgataaatccggtcataaaacccgccgcgctgaggctgtttgtgagaaacatccagcaaacagcgagaagaacatttaataatagttgaaaagccatgccatctactccttcaaaacagcttcaatgtatttttccggattcagcagattctcagccgtctgattgacatacggtgaaacccattcggttccgagcccgaacagaagcgacaaaaggagaaaagcggctgccggataaagaagtccttttgcggaccgtccgcctgcgccggggccggggatttctttttcttccccccaaaaagccgtcgtaaaaaccttcagcacggaatagagcacaagcaggctggataagagaatcaatacggaaaacaatgtttcccccttatcgaacccgccttccgcgatcttcagcttgcccacaaatccgctgaacggcgggatgccggccagagatatggctgaaataaagaacatccatcctaaaaggggataacgggtgatcagtccgcccattttatgcaggctggcagtgcccgtcaatgcgataagcgtgccggcgagcatgaacagcgctcctttaatcagcatatcgtgaatcaagtaataaaccgctccttgaatggaggccggcgtgttcatggcaatgccgaacaaaatcacgccgacggctgtaataatattgtagatgacgattttcatgacatccgaaaaggcgatagatccgattacgccgaataacaccgtcagcatcgcaagccacatcatcaattggtgggtaaagcccgtatcgtgaataaagatcagggtgaatactcttaaaatggcgtacaggccgactttcgtcaaaagagacccgaataaggccgaaatcgcagccggcggggcgtaataagagcccggcatccagaaatacagcgggaatatcccgccctttaaaccgaaaacgacgagaagaaggacgccgatgacggttatcagcccggtctggcccgattcacttatttttacgcttagatcagccatattcagcgtgcccgtcaccgcatataagtaaccgacgccgatgacaaaaaacgcggatgacacaatgttaaacacgatatacttcaatgattctcttaattgaattttcgttccgccaagcacgatcagcatgtaggacgcgataagcagaagctcaaaaaagacgtacatgttgaacaggtcacccgtcaaaaacgctccgcttacgccggccagaagaaactgcacccctgaataatagaaagcgcgctcccttttttctccgatggagcggaaggagtacaggatgacgagcagcccgattatggcggttgtcaaaacaagcagtgcggcaagctgatccgcggcgagcacaatgccgtacggcgctttccatccgccgagtgtcagcgtctgaatcccgtgtgtgaaaacggtctgaacgagagcggcgctgatgacgatggagacacaggaagcggcagtgctgaatatccgcatcagcatcacgtgcctgttcataaaaatcagcagcactgcggcaagcagcggcaccagaataggcaatatcacaaagttattcatgttgatcatttcccctcattcgatccatatcgtccgttttcagttcctgataggcgcgaaacgccatcacaagcaggaaggacgtgacgccgaacgaaataacgatcgccgtcagtatgagtgcctgcggcagcggatcgacaaacgacgtgctttttccgcccagtatgggaggggcgccttttttcagtccgcccatggtcagaagcagcaaatggacgccgtggcttaaaagcgcggtgccgataatcacgcgcagcagacttttagaaagcagcaggtaggttgccgccataaacaaaataccggcaatgacagacattaagatttccattattcttcctctccaatcgtttgaataatggtcatcgtcacgccgacaacaacgagatacacacctaaatcaaacaaagtggccgtcgcaagctccgtattcccaagcacagggagatgaaaatggccgaatgtatgggtgagaaagggtgctccgaataagaacgaacctgcacccgttgcaatcgcgataagcagacccgcgcccgccacataaataaaattgacgggcaaaatcgatttgacggtttttaaatcaaaggccaaaagcaacagcacgatggccgaagacgtaatcagtccgccgacaaatcctccgccgggagcgttatgccccgataaaaataaatagaaagagaaaagcagaatgataaaagatacaagcttcgttgccgtctgaaggatgatgtcgtttgtgttttgctgtctcaacgctcttctccctcctcttttactttcgttctgatcatgccgtaaataccgagtgcggcaatcgacagcaccgtgatttcaaacatcgtatcaaatcccctgaaatcaacgaggatgacgttgacgatattgtttcctcccccgagcttatggctgtaagcggtgaaaaaggaggagatgctgtcttttgttttttcgctggaagacgcgattccgagcattgtcacgatgacgccgacaccgagagaaatgataaaattcgtcatccggaatgttcttgtcttctttttccgccgcattttcggcagatgataaaaacaaagaagaaataaggcgacggatatcgtctcaatgacgagctgcgtgagcgccagatcgggcgctctgaaaatcacgaaaaacagcgcgagtgtgtacccgacaacaccgagtgagataatggccgtcagccgcgatttggcgaacacagtcgcaatcgttgcgctcaccataacgagggacagcacgatttcatacaggccgatttcagccatgcctttcgctgtcatggaaaagccgccttttgtgacgaacgccgttccgatgagaatgataaacgccgcaaagatatacagcagataatcccgcaaaaatccggtcatataagatgacgtcagctggtaagatcttttttccatactgcccgtcaccgcatcgtaaagcttgttcagcgtcagttttttcggaaacagaccgtacaaacgctcccatttagacagcgttacgtaaccgatcgtgccgacaatgatgatgccgagggtcatcattacctcagccgtcaccccgtgccactgggaaatatggacatggaatgtatctccgccggttaacagagccggataaatggagttcatcgccggttcaatcaggctgtaagacaaaacgttcggtgcaaaaaacagactgacggcgcaagcggcaagaatcaccggcgaaatcagcatgccgagcggtgcttcatgcggcgtcttttcaagctgatcaggtttgcgcgcgccgctgaacgttctgaaaaacagcttcatgctgtagatgaaagtgaagacgctcccgatccatgcgagaacggggaacagcacgccccacgtatccaggctgaaaatatctgcatgagcaatccgcagcatacttgtaaagaacatttctttacttaaaaagccgttaaacggagggaggcccgccatggaaaacgttccgatcagtgaaacggtgaacgttaccggcataagcgccatcagtccgccgagcctgcggatgtcccgtgttcccgtttcatggtcgataatgccgaccgccataaataaacttcctttaaaagtagcatggttaattaagtgaaacacagccgcggtgacagccgccgtaaaatactctgaatgctggtaatgaagcgcggcggctcctgcgccgagcatcgatacaatcataccgagctggctgactgtggaaaatgccagaatcgcttttaaatcggtttgtttcatcgcattaaaggaagcccataccatcgtgatcagaccgactgaggcaaccgtccaaaaccagacgggtgaaaatgcaaaaaccggactgaatctggcaatcagataaatgcccgctttcaccattgtagccgagtgcagataggcgctgacaggagtcggcgcctccatggcatcaggcagccagatataaaacggaaactgcgctgatttcgtaaaggcccccaataacaggagaaccatcgccggaataaagaacggatggcctgcgataatatgcacctggttgaccatttccctgatactgaaagaatccgtcatcagatacagcaggataaagccgccgagcatgcacagcccgccgccgacggtaatcagcagtgacttttccgcaccgtagcgtgatttcttccgcttatgccaatacccgattaataagaaggatgacaggcttgtcagctcccagaacatataaagcacgataacgttatcgacgagcacaacgccgagcatcgcgcccataaacatcagcaggtacacataaaaggggccgagcttttctttgtccttcgataagtaaaaaatactgtaaagcgtcaccaaagagccgatgcccgtaatcaataaagcgaataacagcccgagtccgtcaagataaacggtatagttaataccgagggacggaatccattcggccgcatatcggacggtttccccagccattgttacagggagcttgctgataaagtaaacaaacagcacaacgggcactatcagcacaaaccagcctgtatggacttgttttacccgtttataaagaaagggaacgataaatgcaaataaaaaaggcgccaaaatcgcgaaatgtaacagctgcaacagaagacctcctttgcttgttttttcatcaagcaactgctttatgtaagagtgaattaatcaattcacggtcataggacccagtacaaattatatcgcacttttttttaccctgctacggcataatgtattcctctctgtgtttttgtggtcttttgaacccaaaataaatttatcaaatatcctgatctttgtatatacatttatctttcagatcaagcttttaaaaaaggagctggtcagatgaagagaaaggcggcggcctgtattggaatattttgttctattattgcaggaacattcatagcggacgatttctgcaaaacgcggcagcagacggaggcagataattgggagcgtttttttctcggtgcggaatacgcagaagacaagctgagtgcggctgaatcaatgcaaacaccgtttcagccgcgtgagtatatcagaatcgtatatagatgaaaagagttccggcaccagggtgcggaactcttttttgtggcaatcagcgttttcctttaatgtaagggatgccgttggctttaggcgcatccgcgcggccgatgaagccagcaagcgcgagaatggtcagaatgtaaggagccatcagcatgtatacattcggaatgtctttgaacaggggcaaaagcgagccgataatgctcaaactctgcgcaaatccgaagaacagcgccgccccgagcgcgccgatcggatgccatttgccgaaaaccagcgcggcaagagcgataaagccttgtccggaaatggtggagtgcgtgaaatcaagcgcgatcgtggaagcatatacaccgccgccgagcccgccgaacagcccgctgatcatgacgccgatatagcgcatgccgaacacgttgattcccatcgtatcggccgccatcggatgttccccgacagaacggatgcggaggccgaacggcgttttgaataaaataaaccaggaaacaaaggccagtacgatggctaaaatcgacgtataatatacgtcggaaaagaaaatctttcctaaaaccggaatatcgcttaacccgggaatgttcgttttgtaaaagggctccgggattttatcagtctgcgcctttccgtagatcagcttgacgataaacagtgtcgctcctaacgcgagcatattgatcgccacaccggttaccgtctgatcggcgcggaaagaaaccgcggcggccgcgtgaatcagtgagaacagtccgccggcaatcatagccgcagccaaggcgagccacggagcggcggcgccaagctcgcgtccgaaaaataagttgaacatgacgcttgtaaaggcgccgataatcatcagtccttcaagaccgatgttgacaactcccgatctttcagaaaacacgccgccgagagcagttaaaataagcggagccgcatatacgagtgttgccgggacaataatggataaaatctgcaggaagtccacttacttcgccccctttttcttcaatttatcaaggatgagacggatggcgtagcttgatgccacaaacaaaataataatggcgatgacgatgtcaacgacttcagaaggcaccccggattcaatcggcatatttaatgccccgactttaaggccgccgagaagacatgccgccagaacaacgccgattgccgtgctgccgccgagaagcgcaaccgcaatgccgtcgaagccgacgccggtaaaggcgcccttaaccgccgcgtattgaaaggttccgagtccttccatcgcgccggcaagccccgcgaaggcgccggaaatcatcatggcgtacatcatattttttctgacgctcattccggcgtattgtgcggcgtgctggttaaagccgacagcccggaattcaaatccgctttttgttttatgaatgataaaccacatgaggactgccgcaaacagagcgatcagaatgccccagtgaaggcgggagtaatctgtcagctgctctaaaaacggcgagcggagcgacgcgctttcatgaattttgtctgttttgtcccggtggtccgtcatgacatcggaaatgagataattggttaaatgaagagcgatataattcatcatgatcgtgacaatcacttcgtggacaaaaaaacgggcttttaaaaatccgggaatcaggccccaaatgccgcccgcagccgcagccgccaataacgaaagcggaaggtggatgtaagcgggggcgtcaaaggaagcgccgacccacaccgcggcggtccagccgacaaggagctgtccttcaaccccgatattaaacaggccggtccgaaatgcgaatgccacggccaatccggacaaaatatatggcgtaatctggcggattgattccccgatgtaatacacttctccgaaaatgccgctccaaagagccgaatacccgcttacgacattgtagccgctggcgagcatgatgaccgcacccgcagctaacccaaggatgatcgcaatcagcggcacagccagatgagaaagtcgattaatcatgtgttttccccgcctccatttgcttacttcccgccattaaaagtccgagctcctgctcgtttgtttcaagcggattgacgtttgcgatgatgctgccttcaaagatgacggcgatgcgatcgctgagattcattatttcatcaagttcaaaagataacagaagcaccgctttaccggcgtcacgctgctcaatgatctttttatggacgaattcaatcgcgccgacatcgagtccccgcgtcggctgggccgcaattaaaagatccggatttctgtccacttcccggccgataatggccttttgctgattccccccggagagagcgcgcgcaggcgtatattcatcaggtgttctgacgtcgtattcttcaatcaggcttcgcgctttgtcataaatcgtgtgtttatttaatatgccgaaagaagagtagggcttttggtaataactttgcagcacgatattttctccgatcggaaaatcaaggacgagcccgtgtttatgcctgtcctgcggaatatgcccgatgccggcttcagtgactttcctgggcggcatgttttgcagctgtttgccgtttaacgtgatcgtgccggcattcgtttttctgagacctgtaatggcttcaattaattcagactggccgtttccgtcaacgcccgcaatgccgacgatttcaccggctctgactgagagggagagctgtttgaccgcctcaacgccgcgcgcgtccttaaccgttacatcagaaagtgaaagcacttcttgtttcggctcggccgcttgtttatccgtcttgaatgacacttcgcgtccgaccataaggcttgccagttcatcttgatccgtatgtgcgacatcgagtgttgtaatgccttttcctttccggatgatggtgacacggtcgcagacttccataatctcttttaatttgtgggtgatgaggatgattgattttccttcattgacaagatttttcataatctgaatcagttcttgaatttcgtgcggggtcagcaccgcggtcggctcgtcaaaaatgagaatgtcggcgccccggtagagggtctttaatatttccgcccgctgctgcataccgacggaaatatcggcaactttggcttcaggatcaatgtgcaggccgtaacggtcggaaatatcgcgcacgtcccgggcggcgcgctgtctgtcaattcggccgaaagttttcggctcttttccgagaatgatattttctgagacggtaaaggtatccacaagcataaaatgctggtgcaccatcccgatgccgagatcgttggctctgttcgggctgttgatgtgaacgcgttcgccccgcacccggatctcgcctttttccggctgatacaggccgaataaaacgttcatgagtgtcgattttccggcgccgttttcaccgagaagggcgtgtatttcgccttttttcacttgaagcgtgacgtcatcattggcgacgattccgggaaactccttgcgtatattaagcatttcaatgatataatccaccgatttgacgctccttttcagagatactttgatgagaaagagcttggcaaaagaaaagctgcaagagatgcagcttttccttcaccgctcttttcataaaagagaggggataagcacggaagtctccttatcccctggttcttactcagccttgaaggatttcaattctttttcagttgaagggatctcgagtccgtccgcgattttcttcttccaatcgtctgttgctttgatgacatcgtcagaaaggttctccttgtgatccgagatgccgactgcatcttgcgccaaaccgtatgttaatgttttgccgcccgggaatttcccgtcacttgcttttttcgttaagtcctctacggctgtatccacttttttgaccattgatgtcagagtgacattgtcttttgtgcctttgacttgaccttccgcgtactggtctttatcaacaccgataacccatacgttccgcttcggatcttcttttttcagatttttcgcttctgtgaagacgcccgttcccgttgcgccggccgcgtgataaatgacgtcaacgcctgatttgtacatgctttcagccgtcgccttaccgacatcggctttgtcaaatccgcccgcatatttcacttcgacggtcgctttcggatttgcggcttgtacacccgcgcggaagccgatttcgaattttttgatcaattcagactccattccgcccacgaatccgacttttcccgttttgctcgatagcgcagcggccgctcccacgaggaatgaaccttcctgctctttaaatgtaaggctcgccacgttgtcttttttgacaacggcgtcaatgatcgcaaaattggtgtctttgcgctgatcggcgatttcgctgatggaatcctgcatcagatacccgacgccgtaaatcaggtcaaagtgttcccgcgctaatttatttaagttcgttgtataatctgcatctgattttgattgaagatagtcaaaaccgcttttgccttttgtaagcccgttgtcttttccgaatgcctgaataccttcccaggcggactggttaaatgatttgtcatcgacaccgccgatatctgttaccatgccgacggtaaagtttttgctgccggagccgtttgctttgtcacttgaaccgcatgcgcttaatatggttccggccgccgcgatgagcgccatcgccattccgattttgcgttttttcaaagatataacccccctgtaaaatatggctgtgccgttcaattcagacttgagtccccgtaccggatgcagaatcgaaaaaactttctgataataatgatgagacgtctctctttttcccgccttgagcggctgtctcttccgggttcgggacttatgacttatctgaaaagatctgctaaccaatcataatttatcattttacccgccataaataaatagaaatttgcttattttttaaaaaatatcaattttatgaatcggcttcctcatctggataaaacagaggaggatcagccaggtcattatccttatatagcatacaaaaaaggaatctcaagccttttgtcacgggatatgacagtaaaaaagcaccgttcacagcggaacggcgctttttgacattataaatattgtttgatgctgctgacattgccggtgttgatatgatattggaagacgggtctgccgatcgtgccgtacgccatttctacattcagcacttgtatgtcttccagaaatttaaggtatttccggatggagacttgcgagatttcagtatgcttggcgagatcttctgtggtaaaagagccgtcaccgaaagactcaatgctcgcccagatgagtttaagcgtgctttttgtcaatcccttcggaaggtgaaccttttccgccgcttctttcttttgaaaaagctcggcatccaattctttctgtgtcatgcttctgtgtgattgataaactttctgcttgcgtctgtagtcggaaagagcggtttgaaagcggtcaaattcaaatggtttgattaaataatcgacggcgccgtaccgaagcgtttttttgatgacgtccagctcgcttgcggccgaaatgacgatgacatcaaccgattcattttgtttgcggatttccgttaaaagctcaagcccgttttttcccggcatgtaaatgtcaagaaggatgagatcgatatgatgctcgctcagcacgtgcagcgcgctttgaaaggatgatgcgatccctttcagctgaaatccttcaatctggctgagatagcgtttatttaattcacccaccatggggtcgtcttcaactatgagtacattaatcatcattttcctccttcggttcatacggaatgcgaagactgaaagtcgttccttcattcttttcacttgtcacaatcatatggccttttaaattttctgttgcctgctgggtgaaatagaggccgaacccccggtttgtccctttcgtggaataaccttgttcaaaaatacgggcttggtctgccgcagacattccggctcccgtgtccgtaatctctatatcaagctggcgatcctgaaaccgcatcgagcacgtaatgttttttttcggcatctgcgccaccgcgtcgagcgcgttgtttaacaggtttccgataatcgtaatgagctcatggatgacggctggatccgccgcattcgggatcaggctgccgagctgaatgtccagatcagcgccctgttcgcgtatgtagctttgttttcctagaagaaaccctgcgagaaccggacttttgacatcacttataatctcgcttgtttccgtcttctgctgaatggcaatgtctttaatgtaagtgccgagatcatcgtattcttttaactggacaagccctaaaataacatgaagcttattcatgaattcatgagactgggctcttaatgcgtttgcatacattttaacaccggacagctgttctgctaaatgtttgacctccgttttgtccctgaacgtggcgatcgctccgacggtttgtcctttcagatgaatcggaacctcattaaagaccagctcaagcccgttaatgcggatatccctgtcctgaagcggttttttcgtttcaatcacttgtttcagccggcttttcgggagaatatcgttcacatcttgatcgaccggattagtcggaatacccattttaataaaaagccgtttcgcttccgcattggcgagcttgatttttccccgcgcgtcaaccgccagaatgccttccttcgttgattcgagcatggcgctccgctcttccaggagggtggcgatttcataaggctcaagaccgtacataatgtttttgacggtgcgggcgacaatgacggctccgatgacgccgacaaaaatacttacgcagatgatgaaataaagcggtctcaaactgtggctgacgacatcctgtattttgttaagcgaaattccgaccgaaacgacgcccacttgttttttatcttttccatagatcggtacgaaggctctcatggattttccgagagttcccgctgatgtgctcgttttgatatgcccgtgcatcgccggctgttcatctccgccggtgaatttcttcccgattttatttgcgtcggggtgggtgaggcggatgctgttcatatccatcaccacgacaaattcggttcctgtcgtatgctggacgtctaatgtataatcccggagctctttcagcccttttcttgtttgcaatgcccgcgcgacactcggtgtttccgcgaccagctttgcggtgcgcagcgcggtcgtccgttcttcttctttcacgcggtctgctgtttggacgctgatcgtgaaaaaggtgatacaaagtgcgataaggacgacaatacagacgaaaatcgttaatcgggtttgcaattttaatgtttttttcataacagccttccttacgtttatcattcccgcgttctactttactccgaaaaagccggtttgtgaagatcaggcccttatttcgtaaaagtgaggaaaaatggtattttttatcttgtcaatgtgttttaagtcctccataataagtgaggtagattacagaaagggactttttatatgaaaaatacttattggacgggttattttccgctcgttgcgattctgctatttagttcgtcattatccatttctacctcgctttatgtcatgaagatacttcagacgctcggcatgtatcaggggatgctggattatttctctgagaaagggatcagactggcgctttttgcagcgttcgcccttgtgtattttatgcttttttcggctttgaagctgattgcaaacacagtgacagagctgtctcttttgtttttcacaaatgaccctgaaggggacaatctgaaaaaaatcagattaggctctttaatttatgtaggcggaggaattctttcctttgcgctcgtgcagaatggtttttggattgcggcgttatttgccgttgttacgctcgtttatttgattttcatggtgtacagaatctattcgacactctcgatcgtttcgctgatcggttttatattgcttgagattctgttttggtttacttttgttatcggtattttgtacatctttatcaagctttataatagcataatggctagcttacctgtgtaagctagccatttttgttaagacagaaatctgtttttgatctcaggggaggggagcatgcatgcttccctttttccgaaccatttgtaacggcgccgggcgatgaaagaataggctctgtccctgagggggcggggcactgcgaaaaaaaccgctgacagccgccaggctccgcggagatgacgggaaacctttaacacggctgcggattttttgtatatccgcccgttttcgataaaaatcatgctgtcaaattgttctgtcggaagtccttctgatgccaaaagctcccgggcggtatctgattgcaatgaagcaaatgagattttgccggccggatcgcgtttaatgatgaattgaacggcgccgttgcataagttgcagacgccgtcaaacaaaagcacgcggtccggaagctgagctggtttcaaagcggatcccctccgttatctttaataagctgcctgcagcgtgtttttccagatcgaaagctgagggcttgcgtcatgaaggtattcgacgcttgacggtgtatcctttccgacccatacccccatcgtataagcgtccgtcaggccgacaaaccacatatcgtgatagtcatttgacgttcctgattttccgccgacgtacggagctttaaagttcgctttttttcctgttccgcttttgacgacggctttcatcatttctttgatctgcatgttggtccgcacgctgaatacctgcgtcggctcatctttccattttaatatcgtttttccttttaaatcagtcacttttgtaatcgcgtgactcggcgtataaacgccgttgttgccgaacgtggtgtacgcattggtcatttcaagcggagtcatgccgtttgtaaaaccgccaagcgccgcaggcagacggtaatccgcgctgaccagcttcgcgaaatgaaacggttcaaggtagctgaacgccttattgacgccgacgcggtccatgattctgatggccggtgtgttgtacgagtatttaaacgccgtttccagcgtgaccgtaccgtacgtgcggttattgtagttttgcgggcagtaatccgcactgcagaatttgcttgcgtcaatcttgctgtgtggcgttgcgccggtcttttcaatgtaaggtccgtaatcaagcagcggcttaatggatgaaccgggctgtctgtatgcctgataggcacggttgaaatcatatttatgataatctttcccgcctgaaagcgcgataatctgatgtgtctgatgattaatcacggccgctccgccctggacgcctgcatacggcagattttgattcacttgggcgacgacctggttttgcatatacggattcagcgccgtataaatcttcacgccgtcttttaacaatgtgctgactctgtctgaaagctcactctgtattttttgtttcgcctttccggaagctttttcaagacgtttgtcatagccttcggatgatgaaacaagctgtgtgaattcatcatttacataggaaacatagtcaggatatttatttgttttttcgtttatatcaagcttgatcttttccttttcggcttttttcagctgtttcccggatataacgcctgctttttttaatccgttaagcaatctgacttgtcgttttttcgtataatcaaaatgcttgagaggatcatataatgtagggttattagggatggcgcagataaaggccatttctcccaaagtgagagatttcagcggcttgctgaaataaaattgtgccgccgaaccgacaccgtatacgccgttattaaaataaatcgtatttaagtagccttctaaaatctcatctttgctgtatcttttctcaagctgataggaataggccagctccgtcagttttcggctgaaggtgcgttcatggcttaaatacacattccttgccagctgctgggtgatggtgctggcgccctgatcaattttatgatctttgaaattggaggcggccgccctgaccatccccataaagtcaaaccctttatgctcataaaaatgacggtcttcagaggttaaaaacagttgttttacctcattcggtattttattaaagggcacgatcacgcggttctcatgatcgctgacaatctcagaaacaaggcttccgtccctgtcatacatgtaactgttttgaaccaggttgatcgcttttaaatcaatatgtttatcgagcacctgatcaaaaggcttgatttgttttacctctttgccggaagcaataactgtaaatgcacacaacgggataatgccgagcagcaaaatccatccgattattttacgtaccatggtcactctcttttctcctgatttctagccatatcgtatcattcttttaagaatacgagaaggttaaatttagaagaaatcgtgatcgctgccggtcagcccgcatttgacgctgtatccttttgcagatgtcccgccatccataagagccccgcgcctattaaaaagagaaaggcggtgacgtagaaagcagccgaaatggaaaaaccgcttgagaccgcacctccgagcagagggccgagcacatttccgagaaaacgaaagctgacgttatagccgagcacctctccctggatgctgcccggcgccctgacgcggattgcggccgtaatgcaggggagcgtgccgcccatgaccatgccgaacagaaatctgaagactaacagaatggagagggaggaggcgagcgcctgcggaatgaaaaacaccgctgaggcaatcaaaagcacgattaagatccggctgtggccgaagcggtcgccgaagtccccccatttccgggcaagcagtaagcttccgagtccggtcgctgaaaacgccattccggagaaaaaagctaaattaacaggtccgtgcagctcattgacatataaagcgagcagcggctgaatgctgaaattgccggtctgcacgatcatagtaagcaccatcatcgcccaaagcgcgggctggtgaaaaatataagagagcacctgttttctggaataggttttccgtttgttttgtttctcgccgagcggctgctcattgacctgaaataaaacgagaagcacggacgcgaaaatgacaaaagacgtaataaaaaatgtgtacgtaaacccgaagctgtcagcgagcagcccgcccagcatcggtccgaataaagtgcctgacacctgacccatctgcagcgtgccgagcgtcttcccggcagtctctttcggcgtctgcgccgaaatcatggcaagcgatgtcggaacaaagcctgttactagacccataagcagccgcaggacaaacagctgataaacggatgtcacaaaccccatcaataaaatgctgacggcaatgccggttcctgtaatcaagagaatttttttgtagccgcgcttatcgccgaatcttccccaaaacggggaaatcacaaacgccattaaaaacgtgacgccgaacacatacccgctccatctctgcacatacccgcccgaatgggggctgatcgtttcgatatataacgaaagaaacggaacaatcatggtcatgctggcggaaataaagaaatttgtaatccaaatgacgacgaagttcttcttacggacagaaataacatcaccttctttacttttcgtgtatctaatcattagtatataggaatgaatccggtatttgtattttcgatgcggatataggaaaattcattatttttagaaaatgaagaaagtttcagaggggaaattgatatactatcataaaatatcatttttgatcggaggaaaggcaggtgtaaaaaaagtggatcagcgcagtctgctcattattgattttgaatttacaatgcctgacggaaaatacagcccgcaaaatttctttcccgagattattgaagcggggattgtcaagacagtgaatgatgaagtgactgaaacgttttcgagttatatcaaaccgaaaaaatttccgaagctgacgaaacgatgcaaaacctttctgaacatcacccaaaaagacgtggacggcggaatcacgtttaatgaattcatccgcaaattaaatgagcttgatcctgataaaaactgcacgatcgtcacctggggcaatatggatatgaaagtgttaaagcaaaattgcatgtttaaccacatcccttttccgttcaaaggagaacttcgggatctgtcccttgaatacaaaaatttcttcggcgacagaacattgaccggcctttggaaagcggcagaagagtatggcgataaagggacgggcacgcatcataaagcgctggatgatgcgcggacgacatacaaattattcaagcttgtcgagcgggataaacaatatcttgaaaaaccgaaacctccgacgatcggtgatcgcgtcgatctgactgaactgtttcgccgggccacataaaaaaacccaatcatgccgactgggtcaagttcttttaaaatagtcacgctctaacgcggccaagttgtcgagcgaacgttccgcccattctgagccgtccgctgtaagctgatctttcagccgggcagacgccgcttgtaaggaagccgtataatcaggcacctcgccatcaaacggtttgaccatctgatgcggtatgtttgtctgttccccgaatgcaagcgctcttctttcatgaaaaaacggaacatccgcctgcttcggatgatgaagatctccttgagcgggatgcgtcagaacggctttaattttcactaaatagtgattgggcctgacgtctgtcacttcccctatgtatgctcctgttttataaaacccttttacgattgtgccgatgtcaaacgtattcatagcgttcacctctctctagttattctataaaagatcaacgcggttggctagtgaacagctgccggaagcctgactgaggccgttgtgcccgagtgctcgccgctggtgaaacagacggagccttcatgatgctgaataatcgagaatgtcacggtaagcccgagcccggtgccgttcgttttcagcgtataatatggcttgccgagtttctgcagttcttcatcggacatgccgattccgttatccgtaatctgaatgagaatcatctcttcctgtttttggacggagacctcgattcggccgttttcagagggcacggcttcaatactgtttttaatcagattaatgaaggcctgtttcagtttttttacatcgccgaacacatataaatcaggctcgcttcgaaccgtaacggtcaccgatttaaaattggcataagactccattaaggaacctgtttcctttacgagcagagaaatatcaaacttttctttttcatagtcatcctgcttcgccatatcgagataattcgtaatgatcgtctgagcccggtcgagttcggacagcacaagtttctgatatccggagtgggatttgtcctgaagctgctcgccgctgaacagcagctgcacaaaacctctgacgaccgtaagcggattgcggacttcatgggcgacgcttgccgcaagctcgctgacgacggccattttttctgagtgaatcagccttgcccgcatggacgcattctcatcaatgatctcaatcaaataaatgcacagcaaaagggcgctgacttgaaaaaaaacagatactgccgcctcataataaacggaagatagattttgaaaattgaaaatattggtcgcggaatagatgaagacagatgcggttaataaggcggtttcagtgcagccgatgagaagagcgaaaagcagtttcttccgctttgaaaaaaaaggccatttcgtttggagctggatagggatgatgattaaaaaaggaattaaggataagaaaaaaagagcggaaggttcaaaccatatgagctgaaaaaaaacggatgccgcccctgcggcaagtcctgcggcggtaccggaataaagcaggcagacgataatgggaatcagctgcaaaccgtaacggacggaatgaagctcctggatgggaaaagccgtacataataaggaagatgacgctgcaaatacggcgaccagcaggcggttcgctctcggtacaagcaaatcgggcttgctgagccagaagacttgataaagaaaaatagggaataaaataaaagagaagtgaagcaggtaatcctttacaatctccatttatgcgaaatcctttcctatgtaaatatgaatctattataacatctttaccggaaaaaaaagtatatatttctctaaagcgaacgcccttatctcatctgataaaggcgttctttccgctgctaagcgagcgctgctttcattctctcaagcccttcttttacggcggcggctgaacagccgacattaagtctcataaatccttcgccgcccggtccgtattttgttcccggctctaatatgattttcccttttttgagcattctttctttgagctcggcatccgaaaatccgtattcgctgaaatccatccagatcaaataggaagcgtcaggcttcatcatgcggactttcggcaattcttttcttaaaaagtcctcagccaatttcatattcccttcaatgtaaggaatcagcgcgtcaagccaagggcctccctttgtataggccgcttcgattgctgcaaccgcaaatgtgttgaggctggaaatcccgttctgatgcaatgcggcggagaatttcgcccgcttataccgatcgggaatgataatggcggatgcctgaatcccggcaatattaaacgtcttgctcggcgcgacacaagtaacggaaatccgcgcaaactcctcagacagagaagcgaaaggcgtatgcggctttccgtacagcatcaagtcggaatgtatctcgtcagaaacgacggtgacgttatgggcggcgcacagcgatccgagcttcataagctcatcccggctccacgctctgccggacggattgtggggattacaaagaatcatcagcttgacctcagaatcgttcagctttttctcaagatcctcaaaatccatacagtagacgccgttttcttcccgtaacgggttatgtaaaacctgccgtttgttttccttgatcatctgataaaaaggcgtatacaccggtgattgaatcaacaccggatcgcccggttcggtaaaggcttgtacggccatgctgattgccgtgacaacaccgggactgaacgcgatgtttgcgggatcgggccggtagccgtgccgcgtctcaagccatgaagcgacggcttctcttgtgttttcgtcaggagacgtgtaaccgaatatgccgtggtcaaggcgggcttttaaggcgtcagtgaccgcttcgggagcgcggaaatccatatcggcaacccacatcggaagcgcatccgatacgccgaataacgcttccgccttgtcccatttcaccgattgtgtgccaagacggttttctcgaagatcaaagttcatgtatgtcactcctgtagtatcattattttgcacagcgtatctatgataaaatagaattgcaaactttattataagcggtgatgaaaatggaagaaagccaagcggtcatggaaatgatgaaaatcattgccaagtgggacccgtttaaatatggagaagatttttatgagacagaagccgtcgacatcgttcaggccgtctacagtgaagaccgtgccgacaagctggcagcagccattcaggatatctttgaagcttcatttgagcaaaagcttccgatcgaaggatgccaaaaggccgctgagcagcttctgttcataaaagaaagcagctcctgcaccccttaaaaaccggcggttccgccggtttttttattgaataaattcaaaaatccgctccgaaacaaactccgggcgctcttcaggtacgaggtgccccgtatccttgagtgaatacagaatggaatccggcaggtcgtcatgaagccgttttccgactgagaccggaacgacacggtcttcttctccccagattaaaagagcggggttttgcactttcttcaaatcctcgggctctaaatcgccctccctgtgtctgataaaccttgtcatcgctttgaaaatctggcggtctgtaaatggtttttcgtaaccgtcaatcatttcctgatcgataagcgtccggtcgtgaacgacatttaacaggttgttcagcacgccgtcttttgaaagccaatacttaagatacaggtcaaaacaagggagatgcgtcccgaatataatcgacgggtgcgagcgctttaaataccccgagctgcacagcaggacgattttagaaaaaagctcgggtctgagaagagacgcggataaggaaatctggccgcccattgaatggccgatgagtgcggcccggctgataccgagcttttccagaagtccgatcagaagcttggcgaggtttgcgtaagtatatacgaaagtccgtgacttttccgattgcccgaaaggaggcaggtcaacggcgataatatcataatggtttctgagcagcgggatcagttttctgaagctgaatgccgaagataaaaaaccgtgtacgcagacgagtgtctgtctgccgggattttcataatgctcgtaatacagctcaactccgtctatcgcggcccgtttaatcggtgaaacagcttccatgagagccttcgccgtcctttctttgttgtaatgtaaaggcttttttgattgtcagattttagctctggtttctttcgggtttttcttagcatttgtcgaaaatcgtgatataatgtcatgaagatttttgataatgcaaaggtgtgaaacgtatgaagctgaccgaaaaagaaacagaaatattagaaattttagacgaaaacagccgcgttgatgcggaaacgattgcgaaaatggcaaacattcccgctgaagaagtcaaaagcatcattgaaaagcttgaaaaggaaaaagtcatcattgattatgcggcgatgatcgactggcgcaaagtcgacggtttggaaggcgtcacggcgatgattgacgtaaaagtcactccgaaacgaaatgtcggctttgatgaagtcgctgagcggatatacagattccaggaagttgaatcagtgtacctgatgtcaggggtgtatgacttatctgtcgttattcgcggcaacacgatgtcagatgtggcaagcttcgtgtctgaaaaattgtccacccttgagtctgtcgtttccacgacaacgcacttcatcctgaaaaaatataagcatgacggcaaagtctttgaaagcggagacgatgacaaaagaatcgtggtgtctccgtaaatggaaacgaagacttcttatttatctgactacgtgcagcagattaaaccgtcaggcatccgcaaattctttgatctggccgctacgatggaaggcgtcatttcactgggagtgggagagcctgactttgtgacggcctggaacgtgagggaagcgagtattctttctttagaacagggttatacggcttatacggcaaatgcgggtctttatgaactgagagaagaaatcagccgctatttagatcagcggttcagcctgagttattcgcctgacagtgaactgatcgttactgtaggggcaagccaggcgcttgatctcgctgtccgcgccattatgaatcctggagaggaaatgttaattcccgaaccgtgttttgtcgcatatgaatcactcgtgacgctgacgggggcgaagccggtgccgattcagactgtcgctgcaaaaggtttcaaagcatcagcagccgattttgaagcggccctgacggacaaaacaaaagcgctgcttctatgctcgccgtcaaatccgacaggttccgtctattcgaaagaagagcttgaatccatcgctgctttcgctgaaaaacacgacttgatcgtgcttgccgatgaaatttatgccgaactgacgtatgacgagccattcacgagcatgggggccatcagcggcatgaaggaacgcacgattcttatttccggcttctccaaagcatttgccatgacggggtggagactcggatttacggcggcgcctcccgtgatcagggatgccatgctcaaaattcatcagcacgcgatgatgtgcgcgccttccatggctcagtatgcggcgcttgaagggctgaaaaacggtcaggaagacgtcgaaagaatgaagaaaagctaccggagacgccgaaacctgatcgtggagacattgaacgaaatcggactcggctgccaccaccccggcggagcattttacgcctttccttccattcagtcgaccggcatgagttcagaagaattcgcggaacagctgctcattgaagaaaaagtagccgtcgttccggggaatgtattcggcccgagcggcgaaggctacatcagatgttcctatgcgacatccattgagcagattcaggaagcgctcgtcagaatcaaacggtttgttgaaaaaagggcataaaaaaagatacgaacccggttcgcatccaaataaaaggggggaatactagaaagccttcgtaatcatagtataccctcctttatctgtgcttaaacatgattatgtaaaaaagttctctttgcgaaaaacaaacttgtatgatataattttaaattgcgtataatctgtatttaatttaacttaggagttgttatgaatggcagcaaaatttgaagtgggcagtgtttacactggtaaagtaacaggattacaagcgtatggtgcgtttgttgcattagatgaagaaactcaaggacttgttcacatttctgaagtcactcacggtttcgtaaaagacattaatgagcacctttctatcggtgacgaagtacaagtaaaagtacttgcggttgacgaagaaaaaggaaaaatcagcctttctatccgtgcgactcaagcggcgcctgaaagaaaagaaagcaaaccaagaaaaccgaaagcggctcaagcttctgaagaaacatctgctccgcaaggtttcaacacattgaaagataagcttgaagagtggattgaacagtccaaccgcaaagaccttatcaaaaaataatcattaaaaaaagcaccggatatgtatgttcggtgctttttttatgtttatctgacttccggatttgccgcttcctcgcgggatgtttcttcgttcggcttaaacagcaggccgagattgatcagaccggcgatgccgacaaggccgtaaataatccgcgacagagctgatccttggccgccgaagatggctgctactaaatcaaattggaaaaacccgatcagtccccagttaatagcgccgataatcgttaatacgagacagatacgctgaataacactcatgtaaacaacctcctctatgaattcgtgaaacagttatagattgtgacaaagcaaagaatctatgcatactacattctccgccgtgtaaatcacacactgtttcaagctgtacaagtgcctttcccgggaattcgatgtctgtaaaccatgtgatgcgccgtcaaaaaagcggattgctttacattgaacgtcatctttctgcataatataaatccaaaggaggagatgtcatgcaaaactttacatattggaatccgaccaagttgattttcggaaagggagaggttgaaaaacttcctgaagaaatcaaaccgtacggaaaaaacgtgctgctcgtatacggaggaggcagcattaagcgcagcggtctttatgatcaagtaaccgaactgctgaaaaaagcgggagttaccgtacatgaattggcaggcgtagagccgaatccgcgtgtctcaacggtgaacaaaggtgttgcgctctgtaaagaaaacagcatcgatttcttattggccgtcggcggcggaagtgtcattgactgcacgaaagccatcgcggcgggcgctaaatatgacggcgacgcgtgggatatcgtcacgaaaaaacaccagccgaaagaagcgctgcctttcggaacagtgctgacacttgcggcaaccggttcagagatgaactccggatcagtcatcacaaactgggagacacaagagaaatatggatgggggagcccgctcgtttaccctaaattctctattctcgatccggtaaacacatttaccgttccgaaagaccacaccatttacggcatggtcgatatgatgagccatgtgtttgaacaatatttccaccacacgtcaaacacgccgtatcaggaccggatgtgtgaatcgcttctgcgcacggtgattgaaacagcgccgaagctgatcaatgatctggagaactacgagcttcgtgagacgattttatatacaggcacgatcgcattaaacggaatgctgtcaatgggcgcaagaggggattgggccacacacaacatcgagcatgcggtatcagcggtttacgatataccgcacgccggaggtttagcgattctgttcccgaactggatgagacatgtgctcaaagaaaatccggcccgctttaaacagcttgccgtccgtgtcttcgatattgacgagacaggcaaatcagatgaagagatcgcacttgaaggaatcagcaggctgtctgatttctggacgagcctgggcgctccgaacagactcgctgattatgatatttctgatgagaagctggatacgattgcagataaagcgatggcaaacggagcattcggacagttcaagtcactgcagaaagaagacgtgcttgcgatactgaaagcatcattgtaataacataaagggggcggccggattggcagctcctttttttctgtgttatagtaattcccttacgatttttttggaggttatgataaatggagaactttacgtactacaatccgacgaaactgattttcggaaaaggtcaaatcgaccaattgaaaaaagagctgaagcaatacgggaaaaacgtgctgcttgtatacggaggcggcagcattaagcgtaacggcctgtatgaccaagtaacaggcatcttaaaagaagaaggcgcaaccgttcatgagcttgcgggcgttgaaccgaacccgcgtctggaaacggtaaataaaggaattgagctgtgcagaaagcatgagattgatttccttctcgcagtcggcggcggaagtgtcatcgactgtacaaaagcgattgcggccggtgcgaaatatgacggcgacgcatgggacatttacagcaaaaaagtaacggcgcaggacgcgctcccgttcggcacggtgctgacgcttgcggcgacaggctctgaaatgaaccctgattccgttatcacaaattgggaaacaaacgaaaaattcgtatggggcagcaatgtcactcatccgcgtttctccattttagatcctgagaatactttcagcgttccggaaaaccaaaccgtatacggcatggtggatatgatgagccacgtatttgaacaatacttccacaatgttgaaaacacgccgcttcaggacagaatgtgttttgcggtccttcagacggtaattgaaacagcgccgaaacttttggaagaccttgagaactataagcaccgtgaaacgattttatacgcgggtacgatcgcattaaacggcacgctgcaaatgggctatttcggcgattgggcttcccatacgatggagcacgccgtatcagcggtttatgacatccctcacgcgggaggacttgcgattctgttcccgaactggatgagatacacgctggatacaaatgtagaccgttttaaaaacctgatgctcaacatgtttgacattgatactgaaggcaaaacggataaagaaattgcgcttgaagggatcgataaattgtccgcgttctggacaagcctcggcgcaccgtcccgccttgcggattatgacatcggtgaagacaaacttgagctgatcgcagacatcgccgcaaaagaaatggaatacggcggattcggcaatttccaaaaactgaacaaagatgacgtacttgctatcttaaaggcgtcactgtaagatacatttccggccggggtgaagatgaaatagattttcaagctgcagatgtaaccgttttgggagtcccttcattagtgcatcaagagcaagtgaaacaccccttgccatgagacaactatggaaatctcacatgatgcggatttgactccctgtttctgtacatttagcagaaaaggatcaattaactttgcgattgccgatcatctatttacacaaaatctaaatcatgaagagccgcgaatttaaaaaaggagcgctgattcaatcagcgctccttttatgcattttgtgtactaagatcccgctgcgcccccatatagcttcccattaagttttgataaccgggaagatgactggagattaatgcgccaaaaccttcaacatcgttgcgccaatcacgctgtaactcgcatgctacgctgaaccagttcataagctgcgcgccgccatgagccatacgcgttaatgatgcatctgctacttgcttattaaacgtccccgaagcatctgtcacaacaaacacttcgtagcctgctttaatggcagaaagcgcaggaaaagcaacgcagacgtctgttaccacccccgcgataatcagctgttttttgccagtcgcctcaatggctttaacaaagtcttcattgtcccatgcattaatttgtccgggacgggctatttttggcgcatcgggaaagagatcaacgagttcttgcatgagcggtccgttgggtccattttcaaaactcgttgttaaaataaccggtaaatcaaagaatttagccgtatcaccgagagccaatacattgttcttaaattcatcaacgctatagtcacgcacgagaccggaaataaggccggtttgatggtcaactaaaagcacggcagcatcatcttttgaaagacgggaataaagatcagacattttatcatcctccttgaattaaggcaagtaagtttgtcaattgaaaacggtaaatctattcatatgctgtatagaaagaaagttatttctgaggtgacttttcgtgagggggatgatccttcaattaatttggaacgggaaccggagcatgatcaatccaatggataaactgttgtaaatagcgttgaagataacgttttgtttgttcatccgtcagtatgttttgagcggaatcaattttctcatggacttgcgaaatcagcattttttgaaagggcaaaacattgacttgcatagcttcgagtacttccctcatttgcgtttgaccaaaggcagtaccgaaccctccgggggttgctccaattaagccaaccggttttctgtttaaaacagaaggggtccgcggtctcgatgcccagtccaatgcattttttaatacccccggaattccgaaattgtactctggacttacaatgatgacgccgtcaacgtcttgtatatcagctctaaaggatgttacggagtctggtgctccggcaatttctaaatcttcgttaaaaaaaggaagactgtctatttcaacccaacgaaattgagccgcattatcgaaagtcaatcaatgattgagcaattgctcgattatacgagttttttcgtaaacttccacaaataagaccaatggttttagtcataaaatcacctcccggtttaaaatcactttcatcttaacacgataccccaaatatagacactatttttaaaaatggacatttatgccttaatattccttcgtggcagcctctcaagaggagtactatataaaaagaaccggcccatcgggattggcgatggatgtcatcctgctccaaagtaaaggtgatacgttcctggatcaccaacattcgattcgttatccctctcacgattattacaaatataaccatatcgaatccggggtattgtataaaaaatgaatgcatttttagcgcaaatcccatattcatcatgccttcttcatgacttgatttagcgggtgagttcatataaagtgaaagagaaaacaattcaccgtgatggagggataagcaaatgacgcatgtacgctttgattactcaagagcgttaccttttttcaatgaacatgaacttacatacgcacgtgatttcgtaaaaacggcacaccataatatccatgaaaaaacaggcgccggaagcgactttttaggatgggtggacctccctgaaaactacgataaagaagaattcgcgcgcattaaaaaaagcgctgaaaaaatcaaatcagattcagacgtgcttctcgtcgtgggtatcggcggttcatacttaggcgcccgcgcggcgattgaagcgctcaatcattctttctataacgttctgccgaaagacaagcgcaaaaaccctcaagttatctttatcggcaacaatatcagctcaacttatatgaaagatgttatggatcttttggaagacgctgatttctctatcaatgtcatttctaaatcaggcacgacgacggaacctgcaatcgctttccggattttccgcaaacttcttgaagaaaaatacggaaaagaagaagcgaaagcgcggatttacgcgacgacagataaagagcgcggcgctttaaaaacgctttctaatgaagaaggcttcgaatcattcgttattcctgatgatgtcggcggacgtttctccgttctgactgcggtaggtcttctgccgattgcggtaagcggggctgatatcgatgaaatgatgaaaggcgctcttgatgcaagcaaagacttttccagctcggaattagaagagaacgcggcttaccaatacgccgtcgtccgcaacgttctgtataataaaggcagaaccattgaaatgcttatcaactatgagcctgcgctgcaatactttgcggaatggtggaagcagctcttcggcgaaagtgaaggaaaagatgaaaaaggcatctatccttcttccgctaacttctcaacagaccttcactctctcggtcaatacgtgcaggaaggcagacgcgatctgtttgaaactgtattaaacgttgaaaaaccgaagcatgagctgacaattgaagaagcggaaaatgatctcgacggcttaaattacttagccggcaaaacggtcgatttcgtcaacaaaaaagcgttcgaaggcacgatgcttgcccatacagacggaaaagtgccgaacttaattgtcaatattccggagcttaatgcatatacatttggatatctcgtctatttctttgaaaaagcggtggcgatgagcggttatctgctcggagtcaacccgtttgatcagcctggtgttgaagcctataaggtgaatatgttcgcgcttctcggcaaaccgggctttgaagagaaaaaagcagagcttgaaaaacgccttgaaaaataaaaagaaaggctggccctcagcatgacgggtcagccttttttaaaccgtgaaaggtgtgatgatgaatgatacgactcttatgtaagcatgccgtcatttccgtctgttccgccgctattgtctattcggcactaaaactgtctcctgaatccctcttacaaaccatcctgtttttcgctttccctctcggcttgtttacggacatggtccggctgaaactgaagattggccggatgcagtcgctgatcacgaagtgctgtctctatgccgccgttttctatatttcaacggaagccgttctctccgcaattgtgacgtatgttctgattgaatgcgccgttacctctttccagcgtctgtctgccgctcccgattcttcccgggcgccgtatgaagatgccgcagagcggggacgctaaagacaaaaaggagcatatgcacatgatcagcattccatcttcacttgaagggcaatcgtttttactccgcgaactggaacaggtgctgaaaccgatcggttataccatcggaggcggctgggagtatgaccgcgggttctttgattacaaaatttccgatcaggacggctatttatttctccgcatccctgttgaagcaaataagggacacctggatgaacggggggccgccgttacaatcggcaccccctttttgctgaggcacgtctatcaggaggaaacggatgatcacgcaggcggcggtgtttttgagtcattattcaaccaattctccgagccgaaacggcgggatgcggcaattgaccgctcatatacagatatcgggatctcgcttgtaaaagagctggaagacgtcctgctgcattaaagagccaaaaacagatcagtatcgagcacctggtatgacaggggaggggtcagcatcggcccctcttctttttgtatgccgatgatcgtggtattccgtttgagataatagagcgcacagtcatgataagatgaaccctttaaatcctcggggacgggaatgatgcgcacctttttctccagcgtcagatctgacagcgtttgcggtttggcaagctgcagcttgacccggtaatgctcaaacatcacccggctcgacaggcgtgatgtgcacagaatcttattggctcctgcgcgctcggcgtttttgacataccgttccgttaaaatttccacgatacaataaacggacggatgcagccctttgatggcgagaagcgttaataccgacagcatatcagcttcggattcatttttctgctggtctgctgtcaaaatgacggtatcggcttccgtaatattcgccttattgagcgtactgtcatcagcggcatgtccgcggatgaaatggacgttttcaataagcggcccttcccttaatgaatcatcaatcaggacgacagtttttgacggcgcgatgtgctgcagttctttcagcagcatatgcgacttctcattccatccgataagaatgacgtgccccttgcctttaaaggcgaccttcccttcgacatagcgatgctgtttgctgaacacggctgaagaaagcgtggcgaaataggcggttacaaaactcgctccgcttaatacaagcaccatgccggcaatctgcccgagcggcgtctggggcacgtaatcgccgtagccgactgtggccaccgtaataaccgcccaccaaaccccttcaaacacagacgtgaattgcttcggctcaagcatgtaaatgagttggccgaacaataaaatcaaggcgataatgatcagtccgatccgaacatataacggccatctcagccaggaaataaataaacggtttgatttcattcgcccggctcttctttcgacagagagatggataaaatctgcttaataatggtgtttagtttttcgttcagctgttgctggccgtatgagtcacgcgcatgtctgattaaatcggccgtctcatcttcaaactgaatgagaggttcgtcgttttccgattcattatagagctggataaaggcgtcaagcccctcgttcattctgtctatcgcattgctcagctgttctttctcgccatttgtcactttcatgtcgatcacacctgtatcttttttatacagtatgtcccagttcgtttgatgtctttcaaaaatcgccgaaaacatattcaccctcattttttcatatgataaagaaagcggaccgaaaaagggtgagtcaaatgacagtcattcaaaaactgctggcggcgctggccggagcgcagctgctcgcttcggcggccgtattgcttattttcgatttgaatggatacaatcatatgtccggcggattttcatggcttgtttttgcaaaagagaccgcaggcacgtttccgttttacatcggattggccgggtgtatcctcatcatgctcggaggattgattcctgtcagaaaaaagaagcggatttctgtacaggaaagcggacaatcattaaaataatatataagcagatcgtacgatataagagaaaaaggaagaggataatatgctgtttatctttttaacaattgctgcattgggattgtcgttttgggcacaatttaaagtgaaaagcaattttcagaaatactcagacgtagaagcttccagtcagcggacgggggcggaaacggcaagacggattcttgatattaacggtttatatgatgtgccggtagaaccggtaagaggcactttaacagaccattacgacccgacggagcgggtggtgcgtttatctgagccggtatattacggccgctccatttccgccatttccgtcgcttcccatgaagtcggacatgctttgcagcatcaggaatcatacggcgcgcttgtgctgaggcacaaaatttttccggtcgtcaattttgcctccggggttgcccctctgcttttcttgggcgggatgctcctgggcagcttgaacttaatcggactcggcattattttgttttcggccgctgtttttttccagcttgtcacactgcctgtcgagtttaatgccagcgcgagggcgaagcggattatcgtgtcggaaggattcattcgcaacagtgaagaacacggcgtgaataaagtgctgaacgccgccgcgctgacgtatgtggctgcggcgctcgtttcattattcgagctgcttcgttttgtgatgattttcttaaatggtcgtgatgagaattaacacgaaggaggtggccccttaccgtttgcggtaggggtttttttgcttatattaaaactgattctcattatgctgttaatcggattaacggccatctttgtcgctgcggaatttgcgattgtcaaaatccgcggttcaaaaattgcggagctggttgaaaccggagacagccgggcgctcgcggcgcacagggtgatttcaaatctcgatgaatatttatcagcgtgccagctcggcattacgattacggcgctcggactcggctggctcggtgaaccgacgattcagcggcttcttcatcctgttttcagcctgatcggaatgccgtcatccattacgcacgtcgtcacgtttattgcggcgtttatcgccgtcacgtatctgcacgttgttatcggagagcttgcgccgaaaacgatatccattcaaaaagccgaagccgtcagtctgtggacggcgaaaccgctcattctgttttataaagtgatgtatccgtttattaagctgttaaacggttcagccggatttttggtcaagctgttcggttttcattcggtgaaagaacatgaggtcgtggtcagtgaagaagaattgcggctgattttgtctgaaagctataaaaaaggtcaaatcaatcaatctgaattccgttacgtcaataaaatatttgaattcgataaccgggtcgccagagaaatcatggtgccgcgcaccgaaatcgccgtcatctcgcttgaacagtcagttgatgaagccatacatttgatcatcaacgaacggtatacgcgatatccggttattaaggaagacaaagatcacattctcggcattattaacaataaggatttatttaaggcgtattttctcggccgctccattgaattaaaagaaattatgcgtccggtcatcagagtcattgaaagcatccccgttcaggagcttttgatccgcatgcagaaggagcggattcatatggcgattctcgttgacgaatacggcggcacggcgggacttgtgaccgtcgaagacatattggaggaaatcgtcggggaaatccgtgatgaatatgaccaggatgaaatgccccacatcgtcaaaaaaggcgaacaccactatgtgatggacggcaaggcgctcatagaagaggtgaatgatctccttgatatcgccatcgaaaatgaagacattgacacgattgccggctggctcttaacacaaaaaatggagctgaaaaatggtgatgtgtttcatgccgaagggtgtgaatttaaggtgctggaagcggaagaccatcatatccgcttcgttgaaattaaaaaaactgatttctgagcctcctgcttttgcaatgaggctttttttatggaaaaaatgcttcttcgtcccgctccttcatatgctgtaaagaaaggagtgtcggtatgaaaacggattggtggaaaacggcggccgtctatcaaatttatccccgaagctttatggattcgaacggggacggaatcggcgacatgaacggcatcagagcaaaacttcgttacataaaagagttgggggcggatgtgatctggctttgtcccgtttttgactcgccgggcgcggacaacggctacgatattcggaattataaacaaattgccggcgaattcgggacgatggaggattttgaccggctccttgcggatgtccatgcgctcggcatgaagctgattatagacctcgtcatcaaccatacaagcgatgagcacccttggtttatcgaatcacgctcggcgaaagattccgaaaaacgggactggtacatctggagagacggaaaaaacggcaaagagccgaacaattgggaaagcattttcggcggatcagcgtgggaatatgatcaagagaccggccagtattacctgcacctgtttgacaaaaaacagcctgatttaaattgggaaaacgaagcgatgaggcagtccgtttatgagatggtccgctggtggcttgataaaggcatagacggcttccgggtggatgccatttctcacattaagaaaaaagaagggctccctgacatgccgaacccggacggtctcccgtacgtcccgtctttcccgtatcatatgaatggggaaggcataatggatctcttaagagagctgaaacgggaaacattttcgcgctatccgatcatgacggtcggcgaggcgaacggagtggcggcttgggaggcggctgattgggccggtgaagaacacggcgtctttcaaatgatttttcaatttgaacatctcggcctctgggatacggaagatgatcaaagcatctccattccggcgcttaagcgcgtcttgtctggctggcagaacagtcttgaaggaaagggctggaacgcgttatttatggagaaccacgatcagccccgttccgtctcggtatggggtgacgaacgttttttgacagaaagcgccaaggcactcgccgcgatgtatatgctgatgaaaggcacgccgtttatttaccaggggcaggagctcgggatgaccaatgtttcgtttccatccattgaagattatgatgacgccgcaatgaaatatctgtatgaaaaagagacgtcccgcggcgttccgcatgaaaaagtgatgaagatcatctggaagaagggccgggataattcacggacaccgatgcaatggagcggtgaggcgaacggcgggttttctgatgcttctccgtggctcggagtgaatccgaaccacacatggctgaacgctgcatcacaaatgcaggatgaaacatccgtataccatttctacagacggctgctcgccctcagaaaagaacacagcgtattgatcagcggcacatatgaattgctgcttccgaatgaccggcagatttatgcctatctaagaaaaaacggaacaaaaaccgccctgatcatcacaaatctgtctaaaacccccgctttatacaagcatcccggctatccgcttgactccgatacgctcgtgctcgcaagcatggaaacaccaccgcatcggcatgtgacatcctttcttttaaagccttatgaggcccgcgtatatatatggtgaaaaacttcagtcccgaggctgaagttttttgtgatctgcgtttatcatcgcgatccgacaggaaaagacaaatacagaaacgaatatgggaaaggaagagaaaaagaaaggaggcatctatatgctgaaaaaattgcagattcaaacaaacagacgggatgaaatgatcgacatcacacatgaagctgaagcgtttctccgcaaaacaggcgtgaaaaacggcttggcgctcatatactgtccccatacaaccgccggcattaccataaatgaaaatgccgatccggatgtgaagagggatatgctcagaaggtttgatgaaatgtatccgtgggagcacgaactggaccggcatatggagggaaatacggcggcgcatatgaaagcgagtacaaccggcgcctcccagcatgtcatcatagaagacgggcgcctgatactcggaacatggcagggcgtttatttttgcgaatttgacggtccgcgaaacagaacatgttatatcaaaatacaggctgaatcggaggaaaacacaaatgagtgagtggatgagtgcattatcattaacaaagcccgtcattcaggcaccgatggccggcgggctggtcacgccgcgtctggcttcggcggtatcaaatgaaggggcgctcggaagcctcgcttcaggatacgtcagcccgcaagcgcttgaaaaacagcttatcgagatgaaagagctgacgaaccgctcctatcaagtaaatcttttcgttccggaagaaaggcagatgcctgaggcggaactggttgaaaaatggaaagcccgcatcccgagggcaaaagacgccaagccgttctctgatctgaaagaagaatggaatgatttcgaggaaaaagcggagcttctgatccgttacggagtcaaagcgtgttcattcaccttcggcctgccgccggaagaaacggcggaaaagctgaagaaaagcggatgtttccttttcggcacggcgacaacgccggaggaagcgaaggtctttgaagaacgggggatggacgccgttatccttcagggaatagaagccggcgggcatcgcgggtcgtttctgccggttaaaggagaaccggctctcggccttatggcgctgattccgcaggctaaagacgcgctgaatatcccggtgattgcggcaggcggcatttttgaccgccgcggcgtgcaggccgcccgctgtttgggtgcggacggcgttcaagtaggaacaccgtttctcctttgtgaagaaagcagcgcctcaccgggatatcaaaaagccattgccgattcaaaaggagccgacacgcggctgaccaccctgttttcgggaaaacaggcgcggggaatcgtgaatcagttcatgaaaacatatgaggctgacgagggaaatacgctgccttatccgctgcataatacgctgacaaagccgatgcgcgggcacgcggctcaatcaggagacgcggagtatatgtctttatgggccggccagtccgccgcgaaacttgaagggccgacagacgtgaaaaccgttttggaagaattgtgcgaatcataatccagaaatcgtgaggtgatggatgatgaagattcttcaaatgtcctataaaaaaagagggactattgagtttgtctttgaagattttccgcattctaaagtcaccatggcgccgattaaagggtattactttgtccgcgccattaaatggagccgacgggacagagccgtcacccgacatgatttagagaagtttgaatgggctgcaaaccaagcgctcggcacgacggctttttaccggaaaagaaaagcattccgcatcccatcgtcacaatgacagacgatgggattgttttaatgcatgatctgataaagcgcgggtgcatcaagccttgttgcctggttaagcagataagccggctgcacggcatttttttttcttaaagaattcaatctctggatgatttgttcagcggtcagaatcccgagaccgtgggcgaaatattgatcattccccatcacaatgacattctctccccgccactgagcctttgcaggattaaaatcaggatttttaaaatataaacaatctccccgtaaaaagtggctgccggtttccgtgtagatcggcagatgctcatagtgccagtcatacaaagtgatatcccggaaacgccggttaaaccgttcttcaccgattgtctttaagacggccagataataaatcacaacaatggcggtagcgcattcaaatgcgtaaaacgccccgttttcaataatgtcccgaatcgcttttgaagcggggattctgtacttcagctccaaggctccttccggcgtcactctccaataagccgtatttccgtatgttttggcgaaagttgcaaatttcacacctgatccgtgcagttctcttgcggcttccacaatatggcggcgcagccgcacctcgaacatcagttcagcaatcgacccgtaatcgaattgtacgggagaattgagcagttcatttatatacggaacaaggcttttttccgtctgccagttcgcgatgtcctgaggccgaagcacttggccggatatgataatcatctgcgcgccccctatctttttttataagatatgcaggaagcttgggcaatgaaaatcaagtcataaaaaaggaggaaatgttaacaaaatgtgaagactgagccgatatataaggtatcacacttgagggagcagcttaatatgaaaaaattcattaattggtgcacaaaggcatcgatttcacgtaaattaatcatttcatttatcgtgatcttaatcataccgattctcgtgttagaattcagttcataccatacggcgagcaattcgctggatgatcagatttcaggcaacgcgaaaaataacatcgaatcttttaacacaaccattacaaatgatatcggctcaaaagcaaaggcgattgaatttttcagtgaaacgttaaaaggatcatccttctcaaagaaaaacatgtctgctcttgaagaaaagttcgggcaatacacgtctattcataaggacgtagcccgcgtttacggaggaaccgaagacggcagctacgcacaggcgccgaaggagaatactccggccgattacgatccgagaacacgcacttggtataaagacgctgtgaaggccggcggcacgctcgttgtcaccgacccttacaccgcggcaagcgacggcagcatggtcgttaccgtggcaaagcagatgcaggacggaacaggcgtagtggccatggatattacgattgaccagctgctgaagcagatgcagggaatcaaaatcggacaaaaaggattcgtgtttatcacgtccaaaaataaaacctatgtcgcgcataaagaccacaaaccgggcgacaaagtttcaaccccgtggctgaatgaggtatacagcaaagacagcggcattatttcatacaagctcgatgatcaaaataaaaaaatggcgtttacgacaaataaactgaccggatggaaaatagaggggggcatggagctcaacgaaattaaagacgcctcacaaccggtgctgacgatgggaatgatcgtccttgcagcatccattatcatcgggggaattttaattctgttgattgtcagatccattacgtcaccgctgaaacggcttgtccgctcttctaaacaaatcagcggcggagacttgactgaaaccattgatatccgctcgaaagatgaattgggcgaactcggcgcgagctttaatgaaatgggagaatctctgcgcggactgatcagcgcgattcaaaactctgtcgacaacgtggccgcgtcatcggaggagctgaccgcttcagcttcgcagacaagcaaagcgacggaacatattacaatggccattgagcagttttcaaacggaaacgaagagcaaagcgaaaaagtcgattcaagctcagccaagctgaatcatataaatgacggactcaccgccgtttcccgcacatcatcatccattacggaagcatctaaacaatcgaaggaagctgccggcaccggggaagaatatgtgcagcaaaccgtcgggcagatgaatctcatcaatcaatcggtccagcaggcggaagcggttgtaaaaggccttgaggccaaatcaaaagacatcactcatattttaagagtcatcaacggtattgccgatcagacaaacctgcttgctttaaatgcagccattgaagcggcaagagccggtgaatacgggcggggcttctcagtggtagccgaagaagtgcgcaagcttgccgtccaatccgccggttctgccaaagagattgaaaaactcattcaggaaattacggctgagattaatacatcacttcacatgttcacatccgttaatgaagaagttcaatcaggacttgccgtgacggaccgcacgaaagaaagcttccagaatatcttcggcatgacaaacgatatcgccgagaagcttcaatcgatgaacggcacggttgaacagctgtcagacagctcccagcacgtttcagccgcagtgacggatattgcggacgtatctagggaaagcgcagcaagcattcaggatattgccgcatccgcagaagaacagcttgcatcaatggaagaaatcagcacatccgccgatactttggcgcaaatggccgaagaactgcgggaattaacgaaacaatttaaaatcaactagtaaaaaaggacgctttccggatggaaggcgtccttttttatagtgacagccggataattgaataaaaagtcttgcatacaaagggagtacatagaactatttttcatttatgacttaattttcaatgtaataaaaagggagtcggccgatataaacagtaaatgattgaaagaggtttacaaaattgaaaaaaacagcaaaaaaaatcgccagaaaatcaatagccaaaaaactgatcatttcatttttactgatcttaatcattccggtagcagtattggctgccggcgcctaccgttcggcggcttcatccgttgaaaagcaaatgatggaaagcgccgaaggaaatgtgcaaatcttaaacaatatgattgatgaccggatcggaatgtttacaaaaagctctgcatatttcagcgaatgggcgacaagcgctaaatttaaagaaaaaaaccaaacggaaatgcaagaaaggttcaagcagtttattgaaagcaatgataaagcgtccgccgtattttcaagcagcaaggaaggaacgtttacccgttatccgcatgccgatatgccggccgatttcaatccgcttgaaagaagctggtatcaggaagccatggagaataaaggccaaaccatcatcacagacccttatgagtccatctcaaacaaaaagatggtcgtcaccatggcccgcgcggcgcaagacggatcaggcgtcgtcgccattgatataaaaatcgacgatctcatcacgatgacaaaagaagtgaacatcggaaaagaaggatatgcctttatcctcagcaaaaataaaaaagccgttgcctacagtgatgaaaaagccggctcggcggtatcgggaaaatgggttgatacattattcagcgggcaaaaaggcgactttgaatatacgctgaacgggaaagcgaaaaaaatggcgtacgtgaccaatgaagcgacgggctggaagatcagcggaaccatgtccgtggatgaaatcaaggatgcggcaagaccggttctgactctggccgttatcatattggcgatagccattgccgcagggatgattttcatttattttgtcatccgctcaattaccaaaccgttaaaacgtctcgtagcttcagcggaaaaaatcagcagcggagatctgacggaaaccattgatgtcagctctcaagatgagctgggcgtgctcggtaaaagttttaatcatatgacagattcactccgttcgcttattcagggaattcaggactctgttgaacatgtcgcttcttcctcagaggagctgacggcttcggctgagcagacgagcaaagcaacggaacatatcacccttgcgattgaacagttttctaatggaacggaagaccaaagtgagagtattgataaagcgacagcccaagtgaatgagatgaaagacgggctcagcgatctggcggaagcggcagccgtggtgacggaaacgtcaattgaatcggcggagatatccggcgccggtgagcggcttgtcaagaaaacagcgggccagatgggcgccattgaccaatccgtaagtaaagcggagcaagtcgtacaagggcttgaactcaaatcgcaggacattaccagcattttgcgcgtcattaacggcattgccgatcaaacgaatctccttgctttaaatgcagccattgaagcggcaagagcgggagaatacggacgcggtttttcagtcgttgccgaagaagtgagaaagcttgccgtacaatccgccgattcagcgaaagaaatcgaatccttaattcatgaaatcgtcaaagaaattcatacttcgctcggaatgctggaatccgtcaatcacgaggtgaaaagcggacttcagttaacggacgaaacggaaaaaagcttccgggacatttccgttaaaacaaatcagattgccggtgaactgcaaaatatgaatgcaaccgtggaacagctttctgccgggtctcaggaagtatcaaacgcttcagaggatatcgcggccgtctccagacaaagcgcggccggcattcaggacatcgcggcttcagctgaagagcagcttgcgtccatggaggaaatcagttcctccgccgtcacgctggaaaaaatggcggaagaattacgcgaactgacaaagcgttttaagataaactcttaattaagtctaaaagactaattttaagacaggtaaaaagtatgtttcgttatatttcttctttttggatgtgtataattacccataattgccgatatgaagggtaaacacgcaagaggagatatagcagatgaaaaaaattgtgcaaatcatcaagcagagatcgcttacaagaaaactgctcatttcttttttggccattctcattcttcctatttcaacgctggcttttatcgcctatcaatcggcggtaagcacgcttgacaggcagatgatgggaagcgcactagataatgtgcagcagattaacgatatgatcaacacaagcatcagccaaaaggaagacggaacggcatatttcagcgactggctcacaaaggatcggtacaagccgaaaaaccaatcgcaaattaccgataaattcacagagtacatgaagatcaataaagacgtggaatccatttatacgagtgacacggaaggacatttcacacggtatccggatctgcagatgcctaaaggatataatccgcttgaaagagactggtataaaaaggccgtggaaaataaggggaaagttgttgtaacagatccttaccgcacggcttccaccaatacgatggtcgtgacggtcgttcagcagacgaaagacggctcaggagtcgtcgccatcaatatgaaaatcgatgagcttctgaaaacgacaaagaaagtgaacatcggaaaatcaggctacgcttttatcctgacgaaagacaaaaaagtggtcgcccacccgaaccgcacgtcaggcacagtattaaacggggagtgggctgaacagctgttcaccagcaaaaaaggtgattttcaatacaaatacgacggccaggaaaagaaaatggcttatgatacaaacgggctgacaggctggaagattaccggaacgatgtatctggacgaaattcatgaagcggccctgccgatccttcatctgtccctgctcgttctcgtattagcgattgtgatcggaaccatcgtcatggtgctgattatccgttcaatcacaaaaccgctcaagcagcttgtgacatcatcgaaacagatcagtgaaggcgacttaacagaaacgatcgagattcagtcaaaagatgaattaggcgagcttggcaaaagctttaacaatatggccgcttcactcaggtctctcatccatgccatccaggattccgtgaataacgtcgcatcttcctcagaggagctgacggcttcagcggagcagacaagcaaggcaaccgaacatatcacactggcgatcgaacaattttctaacggaaatgaaagccaaagtgaaaacattgaaagcgcggcggaacatatttaccaaatgaacagcgggcttaaagatatggcgaaagcatctgccgtcattaccgaatcctccgccacatcagcggaagtcgccaattcaggcggaaagctcgtccaccagacggtcggccaaatgaacgtcattgaccggtcagtgaaagaagctgaacaagtggtgcgcggacttgaaacaaaatcaaaagacattacaaacattctccgtgtcattaacggaatcgctgaccagacaaaccttcttgcgctgaacgcggcaattgaagccgcacgtgcgggtgaatacgggcggggcttctcagtcgtcgccgaagaggtcagaaaacttgcggtccagtctgccgattcagcgaaagaaatcgaaagcttaatcatagaaatcgtcaacgaaatcaatacatctctcggcatgttccaatccgtcaacaaagaggtggagagcggactggatattacgaatcagaccgaaacgagcttcaaacggatttctgaaatgacgaaccagatcgccggagaaattcaaaatatgaatgcgacggtagaacagctgacagcaggctctcagcagatttcaggagcttctgagcaaatcgcgtccatcgcaaaagaaagctccgccagcattcaggatattgcggcctccgccgaagaacagctggcttcaatggaagaaatcagttcgtcttcggaaacgttatcccaaatggcggaagaattacgtgatatgacgaaacgatttaaaatagattaataggtcatagaacacccaaatgtgctgtttgggtgttttttttagtttttttaataaatcttttgtcctatctgacgatattagatttagcttttcaaagaaggagactgaaaaaatgaaacaactgatacattggatcaaacagccatccatcagcaagccgctgatcgcggcatttttagccgtattggtgcttccggtcggcatactcgcctacttcagctaccaaacggcggggagtacattagaaagcgaactgacccacagcgcccagggaaatgtcagtgaactgaacagcgtgctggaaaacatgcttgagggtaagctgaaagcgattgactacttcagcgaatcaatcacaaaggaaaaactgaacacaaaaaataaatcggtactgcttgacaacatgaagcagtatgtcaccgtaaatgacgatgtcgcgtcaatttacgccgcgtctcgcgacaaagcgttcgtgaaatatccgtccgttgatatgccgtccgattataatccgctcacgcgcgagtggtataccaaagcggttgaaaaaagcggacagccggtgtttaccgagccctataaagacgctgcaaccggacagacggttgttacgattgcccagcagacaaaagacggatcaggcgttgtggcgcttgatattaatcttggcgacctgctgaacgcttccgaacgcgtccagatcggtcataaaggttttgccttcattacaacgggagataaaaaatacatcgcgcatccgactataaaagcgggaacggaaggctccggagagtggacggaagaagtattttccaaatcaagcggatcgtttgaatacatgtttgaaggacagcagaagaaaatggccttcacgacaaacaaactgacgggctggaaaatcgccggcacattttttgtcagtgagatccatgacgcagcctcgcctgtcatgaaaatggcgctgatcatcctggcggtttctcttatcgtcggcggtattttaatcgtttttatcattcgctcgattgcaaaaccgctcaaaaaacttgtttcgacatcagctaaaatcagtgacggcgatttaacggaagtcattgacatcaagtcgaaaaatgaattcgggcagctcagccaaagcttcaatgagatgtcggcgtcactccggtctgtcatcggcgtcatccagtcatccgtcgaacatgtcgcttcttcatccgaagagctgacggcatccgccggacagacaagcaaggcgacagagcatattacactggcgattgaacaattctcaaacggaaacgaatcacaaagcgagaaattggaagaaagtgctgatcacctttcccaaatgaatgcgggcattgccgagacggcgaatgtatcggcggaaatcactgaatccgccatccaaacctctgaaacggccggaagcggagaagaattagtggcgaaaacggtcggccagatgaaaacaattgatcgttccgtacagcaggcggaagcggtcgtaaaagggctggaaacgaagtcgcacgacattaagagcatcctcaacgtcattaacggcattgccgatcaaacaaatctgcttgccttaaacgctgccattgaagcggccagagcaggcgaatacgggcggggcttctccgtcgttgcggaagaagtgagaaagcttgccgtacaatcagccggctccgcgaaggaaatcgaaacgctgattcaggaaatcgtcaaagaaatcgccacatcgctttccgtattccaagcggtgaatcaagatgtgaaggaaggcctcgatattacggatcagacggccgaaagcttcaaaaaaatctcagaaatgacgactcagatttcaggcgccttgcagcatatgaacggaacgcttgagaagcttgcagccgggtcgcaaaatgtgacaaacgcggtggaggacattacctcagtcgccaaagaagggtccgccggcattcaagacatcgccgcctcagctgaagagcagctggcctccatggaagaaatcagttcatccgccgaaacgcttgcgcatatggctgaagaactgcagcaggtcacacggaaatttacgattcagtctgaagacgaagaacagctgtagcgagctgtttcttttcctcattttaaaaaagcgatacactagtataaaagaagggagtggcagtgatgagattagaaggcaaaaaagtcatagcgcttgtcagtgacgattttgaagacttagagctttggtatcccgtctaccggctgagagaggaaggcgcgatcgttcatttaataggagaagaagcgggccgttcatacaaaggaaaatacggcgtgcccgcgacggcggattacgattttaagagcctgattattcaggagtatgacgccgtgctcgtgcctggcggctgggctcctgacaaactgcgaagatatcccgaagttttggacatcatccgtacgatgaacgagcagaaaaagccgatcggccagatctgccatgcgggctgggtgctcatatctgccggaattctcgcaggaaaaaaagtaacgagcacgcccggcatcaaagacgacatgacaaatgcaggggcacagtggctggatgaagctgtcgtaactgacggacacattgtatcaagccgccgcccgcccgaccttccgcagtatgcaaaagcgtttgctgacctgttagcgtccaaataaaaaacatccgcccgaatccgggcggatgtttttagttttgatcggcgggaaagacaattccgatttgttttctcgcttcttccataatgcttgccgtaatgaaagaacgttcaaatgtattttcggaagactcccgctgtccgtttcgaagaagattgatgaattcagccgtttcgtagtacatcgacggtttcagatcagggactgaaatgtcttccgtccggccgtcacgatagcggatttccgcccgttccggtccgtgaatgctgtccagaacgatcgtgccgtcttcaccctgaatttccgccggggcaaacgaatttgagattttcgaatgcatcagcaccgcttcaaatccgtcgtatgacagaatcaccgtgccttcgccgtcaacgccggatgctagtttatgaccggtcgcaatgacgtttttcggtttgccgaacaggacgacggccggataaatgcagtacacgccgatgtccattaacgaaccgttcgataattcaggcttaaacgcgtttagcaccgtaccgttcttatatgcatcatatcgtgatgaatattggcagtagcttgctgtgaatctcctgacgggtccgattttatgtaagtggttttgaagcatgctgaagttcggcaggaacgttgttttcatggcttccatcaagagaacgccgttcgttttggctgcgtgaatcatttcatccgtttcccttgcgttagacgcaaacggtttttcgcacagtacatgcttgccgtgttccataaaaaggaccgcctgctctttgtgaaatgcattcgggctggcgagatacaccgcgtcataggctttgctttccgccatttctttcaggctggtgaaataatgagcagcgccgtgtttgccggcgaattccgccgcgcgttcctcagttctggaataaaccgccgttaattgaaaatcatcaatagcagaagccgcctccagaaatcgttctgtaatccaattcgttccgactgttgcaaatcgaatcattgctatcgctccttctatgtattggcttacattatagctttttttctgagaaacataaatggaaaaaaggctgccagctaaagggataggaaaaattcccatagagaccggttattatttttcattacaggaacgatagtgtacaatttaagtaaaatacatatgatggaggaacaatagtggaaacattgcaaacatggggcggcagatttaaacagtttttcttagacaataaatttgtcttgtttttgcttgtattgctgctcatcggtctcaatatccttgtctttatgaagacatcatttattttcacacctattatcgtcctgctcaaaacgattgcgctccccgtcattttgacaggaattgtttattatctgcttaatccgatcgtagatatattggaaaaaataagagtgaaaagagtctattccatcctgctcctttacctcattattatagggctgattacgattacggtcgtttcaattattccgtttttaaaggaacagatcatgagcctgatcgacaatctgccgaaatatgtggatatcgttgaagatcagacgaaaagcctgatcggaagcgattttgtaaatcaggcgcaaaagacgatgaatatcaacatttccgatcttgctaataaagtatcggcgcaggcggcgacaattgcaaacagcacatttaccggagtcgggaattttatcggcgcgctgacggaagtaattatttcaattgtgaccgtgccgtttattctgttctatttgctgaaagacggcaaaaaactgccgatttatatcttaaagtttgtgcccacccgtctgaaagaacaaacgtatacgatgcttagtgaaatgaaccacagattaagttcctatatcagaggacaggtcatcgtcagcttctgcatcgggtttttattatttatcggctatctgattatcggacttgattatgcgtcactgcttgcggtcattgccgcttgtacgagcgttgttccgtatttagggccgaccattgccatcacgccggcgattattatcgcgttggtcacttcgccccttatgctgctgaagcttgcgattgtatggaccgttgtccagctcgtggaaggaaaattaatttcgccgcagatcatggggaaaaatcttcacattcacccgattaccatcatctttgttcttttaaccgccggaaagctgttcggggttgtcggcattattttagccatcccggggtatgcggtcatcaaagtggtcacgacccatctgtttgattggttcaaaatgcgttcgcatttatatgaagaagaaaaaaatgatgctggatcgaagtcataaaatcggaacggacatgatatttattataagacaggctttccttcagaggagagcttctcttttgtaaatgatgaatgaagggaagaatgggatgacactatgggagatgttcacagcagccgttttgggaatcgtggaagggctgacggagtatgcgccggtttcttccacgggacatatgatcatagcggatgacatctggctgaaatccggaagcctgatgaatccggaagccgccaattccttcaaagtggtgattcagctcggttcgattctggcggtggccattgtgtttaaggatcggatattacatttactcggcctcaaaaaaaacgtcacgcgcgatcagcagaagggatacaggctgaccatcgcgcaaatcgccgtcggtcttgttccggcggcggtgctcggttttttatttgaggatttcattgaccgctatttattctccgtcagaacggtcgcttacggattaattgccggagccgtgcttatgcttatagcggactggatcaataaaaggaaagaaacgatcgatacggtagacagaatcacctacaaacaggctttctgtgtcggattattccagtgtctcgccttatggcccggattttcccgctcaggctcaacgattgccggaggtgtcattgtcggcttgaatcaccgggcagccgcagacttcacatttattatggctattccgattatggcgggcgcaagccttctgaagctggtgaaatactggagcagtctttcttatgacatgattccgttttttctagtcggctttatctgcgcctttgtcgtcgccctcttagtcgtcaaattttttcttcggcttattaaccggattaagcttgtcccgttcgccatttaccgtgtcatcctcggcatcattttaatcatgctcgttcgataaacgaagaggcccccggagggtcttctttttatgttcgaaaagcgtctcaggaaaatatgagcaaactgaattttctgcttgaaattcaaagaagactcgtctataataaaacatgacgttacagcacggggccatagctcagctgggagagcgctacgctggcagcgtagaggtcaggggttcgagcccccttggctccatacctttaaacccttattctataagggtttttttatttgtcaggaacagagccaatagccctaaaaagcaattggggacaattttgggacgaaaaatttattttgaggaagtttagttgcttttcgccttcaattaggattgaagaagccgcctctaaaggcggctttgttgtttatcaattttcttgcggagcaatctttgctggtgtagcaccgcagaacaggaagaatgtaaataatactggtggagaaattgctacacctaatttgcctatatattccaatactgtccaccaatctcctttttcaattgccttttgaactttatctaatgctcctttagagataccaatagcatcttcaaggcatctttgaacagtgttcttttggacacttgcatacttatattccttgttcatatagttagcgaaggcgatcataccctctttttgacctttggtataaggagacttttcaagctcaccctcattaactgtgtaacctgtttcttcatcaaaaattacaatcttagtaaagatgtactcaacttcttttaaagatttttcaatttgttctttagttaatccatctaacccgttctcttcctctgctgaaactgttggcgctattgtagcaatagcaagaagtagggtcaacgccagaaaaactaatcttttcaacattataactcccccttttggaaaattgtacaagcaactacatggtaacacatttttttccaaatgagggtatgtttatccggttttaatctgtttagacaggataagtcaaatatcgacaaaaaagattatgaccataaactcaaagcaagagtcgaaaccccccatgctattatcccaaacattacagagaacctaagacaagcttcaaattttgaaagccctcgctctctttttgttttacctaatttccaataaatagcgtatccggagaacaccaaaatgattattccaagtcgtgtcatgttttctaaaaattctataccatccattgattttcacctcgtttttatttatgagaaaaaataaagtagacttgtagagagtctacttatacacgtttatccaaagtacacatttctttagagctgagaacgcttgagtgataaagtaaggctcattttaaaatggcacatccttatcccctccccatttgtattcccgacacattagttttattatcgcaaatagaatggccatttccaacagttatgtgaaaataagtaatgcgtaatatgtctaatggtataagaaatgatgtatcttttatccaacaaaatcatgattttataatcactgtagaccgcaaacaaattgcggttttttttcgttcaaacataatttggaaatgttagaatattatataaaaggaggagtggccttgtgagttctgttttaccatcatcggaggttggcgttaagatcaatgaatggtacaaaatgatacgtcagttcagtgttccggatgcggagattttgaaagtggaagtggaacaagaaataaatgagatggaagaagacgagtatctactgatttactacaccctcatgaaattccgccatcagcttatgctggattatttagaaccggtgactacccgcgtgagaccgacaattgacgagctgctggaaaaaatcgaagcatcaaataaaggaatttccggcctgctgtgctattattctttatttttccgcggcatgtatgaatttgatcaaaagcagtatgtaaaggcgatcggcttttatagagaggctgaaaaacaactcgttcatgtgcatgatgaaattgagagagcggagtttcattttaaactggctgaagcatattacggtatgaaacaaagccacgtctccatgcatcacgtaaagcaagcgctcgatatttacgatcagtatgagttgtataaggtccggaaaattcaatgtctatttgtcgtatcagggaactatgtagactttaaacgttatgaaaaaagcttgccgcatttagaaaaagctttagagttgtcgaaacaagtaaacaataatgaaaggctgctcagttctgcttattacaacataggaaagaattacggagacttagaagaatacaataaagctgaaatctacttaaaaaaagcagcggagatatctgaaaagtataaattgggtaaccttccgcattccttgtttacatacgcaaagcttctatttaaacaagggaaaacaagcgaggcgattcaaatcagcaaaaagggactttcatcagcgatatttcaaggagataagctgtttgaatctctgcaaaaatatttggaggctttatatattaatgcaatagaccaaataggaatcaaacaaacaattgattaccttgagaaaaataaaaactattcgtatgtagaagatattgctcttgatacggctgctgtttatgcagagtcaaagcaatatgacaaatcttatttttatcatcaaaaaatgattcaaacgcaaaaacaaattcagaggggagaatgcctgtatgaattttagaaaaggcgtatttatcattgtgtcggctgtcgttttaatgtcagggatcggtctagcaacatcggctgtttcatttgatggatcttatcaagtttcgtctgatcgtaatcaaacctaagaaggagagtgcctgtatgaattttaaaaaaagcatcttcattattttgggtctgtcgttatcttttatatgcgaagtgggtgtgaacacagtggaaaaacaaacacatgatacctttcaaactgcctcagatcgtttccagacttgatcagcttacgccttttcttcggaaaaggcttttttcctttcttcattatattgtttcaaaacatccacttgtttttattcttatcccatttcagcatacgctgcctcatgaggttcttcactgcttcccggatagcgcgttcatccttgccggtttttctcttcaattcatccaaggaggggttttttccgaattggatcatgttaaagataatccggtacacttttcattcgaaatcagtcatttgatcatctcccacttcataagtctcaacggataaaagagaatcaaatacaataatgtatccacctttaagttctcgacaagagtttccttccgtatgtggtcccgtaatgaactgcgcagataacctcgcgtatgtattcgtcgtcttaaagctcgaacgataaatctatgctaatattaaaaaaatatggcactctatatttttagatcttaagaatatataagaattgataagctcaattttcaaatttaatggagggaaaatagaaaggagagaaatgagaaagtattttggaatagtgtcgcttatcatccttttattcgcattgtgctttctgcctcatattcattgggcgcttggaatcctaggaattgtcgtggggagtattctagcaatcaaatcgcctaaaggaattgcaaagaacatttcttttgttatcctagcactttgtttacttttactattattattgattgtgatgggcgttttgatggcaggtctagtggaaaattaacctttaatttattatcctatttggggaccaacttattcatttttagccaaataaaagattagggtttgaaataaaacgtctgttcgtatcaggaactcatctccacaccggcagcgtagaggtcaggggttcgagcccccttggctccatacctttaaacccttattctataaataagggttttttttgttttttcatcttctgcggcagcctctatgttctgcttcatttctaacaactcaaaataaaggaaagagagaaaatgaaaaagaaaatctatcttctactaactctttcagcggcactggcacttcttttaacagcgctcccggctctttctcccgtcgtcttcacgtctgcttcagaaaaaggagccatcaggcatgacatttataaaaaaggatatccgtatcaaagctactttgcgattcttcgaaaagaagaaggcggcggagaggccgggaacctttattatgtaaattggttcaattggaaagatgataccggacagacgccgcacgtatgttattcaaaaaaatcgtccgaaggcgagtacaaagtaagctgcggaaccggaccgtaatgatcaagagcccctcttcaatgaggggctctttctgtcaatgccgctctggctctccgtttaatatccccaatataacggcgtatcataatgccgatacggatcattcggataatgcgtatttggctgataaggcgtattcatatcatgaatccccgtgttttcagtctgtccgcagtatttatcggggcctatcacagttgattgccggatcggtgaaacggctttttcccactcatgctcattcagacagtacgtatgcgccatgatctcaggcggcgtcagacggagaatatccgagccgtatatcacttcaggcgaaggggcgtcaaatatggccaaaaggtgggttttgtctgaagtggcgacttcataatgccaccacccctgcggaacattcgccacttgtcctgaagagatcggataattccgtattttctgggtgaacggattcagcatcgacaccaccgcggaacccgaaatacagtacaccaattcagcggcgttttgatgggtatgcggttcaatcacatttgttttgctcagaaagatatctaataatgaaatattttcaagcgtgtttaactgtttaatccccaatacattgataaagttccgagcatctttcgtaaaaaaacggctctcattcacatcataagtgaactgtgtattcggagacgtgtaatcgatatcggaaaccatgcactcccccgctttcatctttaaacgtatattcccaaatatatgtgtccctgtttcaccgggtgataaaaaaaggaggtgaaatccataaattccaaatccaacacaatattgtgacgacttttttaaagattcattttcaatatatcttttattcgaaatatctcttactataaagatatattgaaaatacatctttagaagggttgaggattaacatgctggatgagagaacaatagacatcatcaaaagcacagtacccgtattgaaaacacatggagaaaacatcaccggacgcttttataacctgatgtttcaagatcatcccgaactgttaaatatgtttaaccaaacgaaccaaaagaaacagactcagcgcgcagcattggcaaatgcagtcattgcggctgcggcgaatattgatcaattagaacaaatcattccggcggtcagacagatcggccataaacacacaagcatcggtgtaaaaccggaacattatccgattgtcggaaagtatctgcttctggcaattaaggatgtgctgcaggatgccgcaactcctgagattatgcaggcatgggaaaaagcttacggtgttattgcggaggctttcatcggcattgaaaaagacatgtacaatgaagccggatggcaggggtataaagaatttacggttatacagaaaacgaaagaaagcaaagatattacatcattttatatcaaaccgagtgacggctcttcgcttcctggatttgaagcgggacaatatatcagcattaaagtgcggattgcggattctccttatacgcacattcgccagtacagcctgtctgatgcttctcaaaaaggggcatatcggatttctgtgaaaaaggacggagcggtttcttctcatctccacaatgaagttcaagagggagataaacttgaagtcagcgcacccgccggggatttcaagctgtcttctgccgaaaaaccggttgttcttatcagtgccggctccggaatcacgccgatgatgagcatgctgaaaacagccgccgaaaaacagccggagcgttccgttacttttattcatgccgcgaaaaacggagagtacgccgcgttccgcaaagaggctgaacaagctgcggagaatcatccgaatattaacattatttatgtatacagtgaaccggcagaacaagaccgctcaggagacaagcctttttacagcggcaggattgatcaaaccttcttggagcagcttcatctgaatcaagatgctgaatgttacttgtgcggatcagcgcagtttatgacgcaaatgaaagatatgattcttgccctcgggtttgactctgattccgttcaatatgaattgttcggccctcagctgagcatggcataaccaaaaagactcctcaaagaggagtcttttttatttgcgcaatatgttctttctccgtctttttccctattttattgaaattttcatcaatgaccagtaaaattataaatctagtgattccggaattaaaggaaggttgatatgaaaaagaaagcaaagaccaaaagggggcttgggtgcctttttgctgtatctcttatattcggattatttctggtatcaatggtgttttcgaaattcatagtgacggaagaaaaaccgcctgaagaggtggacgagcagcaggtctttattgacagcctttccgggcatgctcagattttatatgagaaatatcatgtccttccgagcatcaccctcgcacaggccattctcgaatcggactgggggaacagtgagcttgcggggaaagcgcgcaacctgttcggtgtaaaaggtgattataaaggaaaacacgtcacgatgaaaacggatgaatttgaaaaaggaaaacgaaaaacgattcgggcaaaattccgtaaatacagcacgttttttgaatcaatggatgaccatgccaaattatttgtcaacggaacgtcttggaataaaaagaagtataagcctgtcattgaagcggacaattataaaacagcggcggctgcccttcaaaaatccggctacgccacagaccccggctatgctgaaaaaattaaagatgtcatagaaacctataacctgaatgaatatgacaaaatcaatgcctctcttaaagcagttgatatgaaaggcgccatcaaagaccacgccattgaagacgtgtggtccaagccgtcaaaagagcggcattctattaaactggcatcggcgcaaaagtttaccggccagcatattaaagtcgtatctgaaaaacaaaacggagaatccgtctggtaccaaattcaagtgaaagatgagctgatcggctgggttgaccaaaccgccgtccagttaagtgaagaaacataagcatcaaaaaaagccggcagcccgccggcttttttacattccttcagtttcaaaccttttaatatcacgtttatgccccatcagcacaaggcagtcacattcatgaatgacagtctccggagaaggggacagctgaatgtcgccgttatgtttcacggcgagaatgctgcagccgaatctggcccggacgccgagctcaagaatggattttaaatgcagctttttcgtggctgaaagctccacgatgctgtattcatctgacaaatcaatataatttaagacgttttcatccgaaaggctttgcgcaatccgcacgcccatatccttttcgggatggataatacgatcagcaccgatcttttcaagcactttgtgatgataatagttttgtgctttcacccaaatattagggatgttcagctccttcaataacagcgtcgtcagcgtgcttgcctgaatgttggcgccgattgctacgatgacatattcaaaatttctgatgccgagcgactgaagctcgctttcttccgttgaatttgcccgcacagcatgcgtggcataagaggagtatgcgttgacccgctcttcgctgatatcgaccgcaagcacctcatgccccattttaaaaagctctttacagatgcttccgccgaaacgtccgagtccgatgacggcaaattgtttatttttgatttttcccaatcctcataactccttaagaaactgttttcgtcactccaaatacaacaaacaagaatgtactcctgtttcaagggtttgtcaatgcgagggccggaagaaagaaaacagcacgaaaaaagaccggctgacaagcgatgggcttgtgccggtccgtttttcgcaattatttgcagttgcaaggctgtgtcggcggtgtgctgcgtttttgaacaacaattgtgtcctcagcatagaatttagagccgatgcttaatgatttattttctgcacggaacttatatgtacctgcagcaggcaatgttttattattaagagaaagcttaaattccgctgcgccgagcaaatcaatgtttaacggaagtctgactgttttgccgttattcagaatctgtctttcacgcaaagcgtgtccgttgactgtatcttttgttgtagccgcaaatccgctaggaagggtaaattccataacgcctaagctcaggatcgtgttcggacggtacgtcaattcgatatcagaaaatgaccattcctgctggctggcacctgtatattttgcaaataaggtagcagtcgctttcgtggacatttccggctcgtgaacggttgagcctgactcagcggcgaatgacgctgtcggcagagaaagaagcaaaaccaggccgaataaacttgccatgacagttgagaaaaatttctgtttcattttcataaatccccctaaaaaaaatttgctggttgttcttaaaaaagaacgaccatacctataaaaatttaccatcaattttaatggaagtaaatggggttatgttcctatattttctcaaaaataatcaaatcacgacaaaaaacgcctgattttgattcaggcgtttttttcgtcggtttctatcggaataaatttaaaaatctccccgctctgaaccgagtcagcgagacgcttcagccaatgataataagctttcgaactttcaagctgatcatataactgccgcgcttcttcctgtaattccgcgttgccttcctcggccagcaaaacggactgcaaatccgcctgggcctgttcgatggcggacaaattcacctgaacttcacgatcccatttcggcgggaagaaattcgtgaaaaacgtaaagaaatctttttccgctacaaacgtatgcttccgtgtgccgcggtgaaaggtttttttgaccacatttaaatcctgcagctttttgacgcctgtgctcatactcggtttgctcatctgcagttcctcacgcatttcgtcaagcgtcatttcatccctcatatacattgttccgtataaaatcccgacactccgggtgattccgtaaagatccatcgtctctgcaatggaatcaatgacaagatccctggcttgttctatagctgcgaattctggattctcatccatactgtccctcttttcctcttgaagtttaaatttgttaagtcatttctttatgttcttaatcttaacgaatcatgacaaaatgtcaaaatctaaacggactgaccgggttttgacaggtaaaaaaacatgtgttaaattaatattgttaaaaacattaaatttttatttaacaaacttacttttcggtaaggaggactcttatgagcaaaacgctttatatcggcggcgaatggatcagtgcagaaaaaaaacagacgcgccgtatcattaatccatttaatcaagaagaaattgcaacggtatgcgaaggagaccgggatgatgcggtgaaagccatcgccgcagccagaaaagcatttgatgaaggggagtggccggtgctttccgggctcgagcgcggacaatttgttctgaaaattgcggaattaatcagacgcgatctgaacgaattagctgagctggaatcgctcgatacaggaaaaacgattgaagaaagtaaagccgatatggatgatatcgcaaatgtatttcaatattatgccggtttggcggataaagacggaggcgaggtcatttcatctccgattcccgattccgtaagtaaaatcgtcagagagcccattggcgtatgcggacaaattacgccgtggaactatccgctccttcaggcgagctggaaaatcgctcctgctcttgcggccggaaacacgatcgttttaaagccgagcgagattactccgctgacaaccattaaagtctttcaattaatagaagaagccggtattccgaaaggggtcgccaatctcgtgctggggccgggcgcctctgtcggcgacgagctggcgagaaacctcgacgtcgatttggtctcttttacgggcggaattgaaacaggcaaaaaaatcatgcaggcggcaagcggcaatgtgaaaaagattgctctggagcttggcggcaaaaatccgaatatcgtattccaagatgcagatctcgaaacagctgcagatcaagcgctgaacgccgtgtttttccatgccggccaagtatgttcggcagggtcccgtcttttggtggacgaagccattcatgatgaatttttagccgagctgatcaagcgcacgaaacgcatcaaattaggaaacggttttcatgaagatacggaaagcggtccgctgatttccgccgagcatcgggccaaagtcgaaaaatacgtagaaatcggcatcgaagaaggggcaaaactggaaacaggcggcaaacgtcctgatgatcccgcccttcaaaacggtttcttctatgaacctactattttctcaaactgcaagtctgatatgcggatagtccaagaggagatcttcggccccgttttaacagttgaatcattttcttctgaagaagaagtgatcagacttgccaacgataccatttacgggctggccggagcggtatggtcgaaggatattgaaaaatgcgaacgcgtagccgccaaactgcggatgggaacggtatggatcaatgatttccacccgtatttcgcgcaagcgccatggggcgggtacaaacaatcgggcttcggccgcgaactcggcaaaatcggtctggaagaatacacggaaatcaaacatatttaccgcaacacgaaacctgcggctgtgaactggtttcaagcataacgaggaggagatacaatatgacattaaatatgaaagtagaaagcatgcataaattccatacattcgaaatcccgacagtcattaaacacggaatcggtgcgattcagcacgcgggaagtgaagtcagagcgcttggcgtcacaaaagcgctgctcgtaacagacccgggaatttataacgcaggagtggcaaacccagtcattgaatctttgcaggaagtgggcatcgaagtcgtcctgtttaacaaagtggagccgaacccgcctgtacgtcttgtaaacgaaggatcagaactgtataaaaaagaaaactgcaacggtcttgtggctgtcggcggcggaagctccatggatacagcgaaagccatcggggtagaagcgacacacgaaggaagcgtgcttgattatgaagccgcggaaggcaaaaagccgctggaaaaccgtattcctccgctgacaacgatcccgacgactgcgggaacaggttcagaggtcacacaatgggcggtcattacagatgaagaaagagaatttaaattcaatacgggcggaccgcttatcgccgcgcatttaacggtcattgaccctgagctgcacacgtccatgcctccgcatgtgacggccatgacaggtattgacgcacttgcgcacgccatcgagtgctatacgatgaaattcgcgcagccgatcactgatgccgtcgctttaatggccattgaatatgcggcgcattatattaagcgcgcgtttgcggacggagaggatttggaagcaagatacggcatggcgcaggcggcgatgcttgccggcctttcatacggcagtgaatcagcaggcgcggcgcatgcgatgagccagacgctcggcggcatcatccctgtcgctcacggacaatgcgtcgcagctatgatggggccggtaatggaatacaactggaaaggctatccggaaaaattcgcccgcatcgccaaagcattcggaatcgatacaagcaacatgacaaccgaagaagcggcaaaagcgtccgtcaactggatgtatgatcttgtaaaagatttagaggtgccgagtttagaagaacaaggtgtgtctccggacatgattgaacgtttatcaaaagaagccatgaaagatccgcaaactttcggaaatccaagagatttgaatgagaaagcatacaactggatttacaaacgctgctttgacttaacgccgaaaacggtataataaatgaaccccgctcctttacagagcggggttttttaaggataatgtcaagaaaaaggcggtggtggctgatgtggaaacgcataacagcaaagacggaaggcgtatatatagcggataccgaacaatttgttaccaaaaagatggacaagcttcgcgcggaatacggcgggttccccggtgacttgcatttcggactgacaaaaaaggccggcgcgcgtgagccgatgtatgaaagaggaacagaaatttttaaccggagacagatttcaatcgtgtccatggaggaatgtgatgacattgcggagaagatggggatttctcatatctttcccgaatggctcggcgctaacatcgcaatcagcggtttttctgcactgacgccgcttaaagaaggaagcagaatgatatttccaagcggtgcgtctctgttgtgcgagggagaaaatgatccgtgcattcagccgggagaagtcattcaatccttttatccggatcagccaaaactcgccgcggcgtttgtgaggcacgcgatgggcagaagaggaattgtctgtattgttgaacgcccgggtgacatatgcacgggcgatgcggtcaccatccattcttatgaaccgaaacgcgccaagaaaaaaatcgagaaggtctgactcagaccttttcgattttttgtttgatttcttttatttgattaatgtgacgcttttcatgatggccgataaaatcaatccactggcggatcgtcagttcttgaaaaacaggatgcggaagcacacgttcaaagtcttcctcgtttaatgatgaaataactgcggtcagctgctgtcttgccgtatctaattcttgttttgcttcaatgactgataatcggttttgctcaggttcgaggtgtgacggcgccggccgtttatctgttctgtcctctataaactccatcggtttttcttctatttcttttaacggtgcgtcttttgcctgctttgataaaagggtctgcgctgtttcgtcaattttctttaaatggtcaaggacttcccgcacgctccactcatcagccgcgggctttcggttgaattcctcatcagagagtcctttcagttcttcccagatctgctgtctggcttcattaaaaatgctcatcctatctcctcctttagagtaaacatatcatatccggattggataatcatgtaatcagccttccttatcagaaaattgaaaccatttacctttacatccgtatataaagtaacactccgacacctcggccgaaaggaggatagaagatggacatatttcatctgccgcttgaaacggtctatctttacacattgattatttcgggaagcctcacgcttttgattctgttttttcaagatgtgtttcacggcctctcggaagccattcctgtttcatttttaaaccctgcattgattctgtcttttttaacaatcttttcagcctcaggttatatcggcgaaatcgccgctccgctatcaagttctgtcattgcgttgctttcatttgttctttcggttcttttggtcagcctgcttcacttcttcgtccttgtcccgctttcatcagcggaagaatcgctcgcttatcgggagacggatttaaagggcagagtcggcagggtcattacttccgtcccgaaagacggctatggagaagtgatcatagagggaatagggggcgccatttctaaatcagccgtcagctttgatcaagaacagatcaagtacggaactgccgtattagtgattgacgtgaaagacggagtgctttttgtgacgccgcatgaaccaatctgatatctaagggggaactgttatgactatgccgattatcatcgttatcggaatcgtattctttttactcatcgcacttattgctgtatttattacgaagtaccggacggcggggccggacgaagcccttatcgtgaccggaagttatttgggaaataagaacgtccacattgatgaaggcggaaatcgtctgaaaatcgtccggggcgggggaacgttcgtgctcccggtattccagcaggcagaacctctcagtttactgtcaagcaaacttgatgtctctacacccgaagtctatacagagcaaggcgtgccggtaatggccgacggaaccgccattattaaaatcggaggctctatcagtgaaatcgcaacagcagctgaacaatttttggggaaatctaaggaagaccgtgagcaggaggcgcgggaggtgctggaaggccatctgcgctccatcctcggctccatgaccgttgaagagatttataaaaacagggaaaagttttctcaggaagtccagcgggtcgcgtctcaggatcttgctaaaatggggctcgtgatcgtttcttttacgattaaagacgtccgcgataaaaacggctatcttgaatcattaggtaagccgagaattgcccaagtcaagcgggatgcggacattgccacggcagaagcggataaagagacgaggattaaacgcgcggccgctgataaagatgcaaaaaaatcagagctggagcgggcgacggaaatagctgaagcggaaaaaatcaatcagctgaaaatggcggaatacagaagagagcaggatacagcaaaagccaatgccgaccaggcatatgatcttgaaacagcaaaagcccgccagcaggtgacagagcaggaaatgcaaattaaaattattgagcggcaaaagcagattgaattggaggaaaaagaaattctgcgccgtgagcgccaatatgactctgaagtgaagaaaaaagccgatgctgaccgttactcggtggaacaagcggccgcggccgcaaaagcgaagcagctcgcagaagcggatgccgagcagtacagcatcgaagcgatggccaaggcggaagcagaacgcgtgagaattgacggtcttgctaaagcagaggctgaaaaggcgagaggagaaaccgaagcggaagtcatccgcctgaaaggtctcgcagaagcggaagctaaagaaaaaatcgccgaagcattcgaaaaatacgggcaggctgcaatccttgatatgattgtgaaaatgctgcctgaatatgcgaagcaagtctcagcgcctctttccaacattgataaaataaccgtcgttgatacgggaggaagcggtgaaaacggcggggccaataaagtcacaggctacgcaaccaatttaatggccggtcttcaggaaagcttaaaagcatcttccggaatcaatgtaaaagagcttattgagaatttttcaggcaaaggcaacataaaacaaagtataaatgaacttacaaaagaactgagtgattcgaacgaacggcacagcccggaataaaaaaacagcaggcgtaaaccgcctgctgtttcagttcgtccgcttagcttcaagaagccgcggcgcagtcatgaataataagataaggacaatggccgaaaggataaaagaaggaatcatataagtcgcgttatagacggacgaataaatccataccggcgtgcctttcggagcatagcttccgaaaaagaccgctccggagaccacatgtgccgcatagcgcagcacactgccgatgaaaacaccgcctataacatacatcgttaaagcgcctctttttttattcaatgccgattcccgtacaccggaagcaaacaagccgctgaaaccgagaactgcaaaggccgcgatgtaatcaagaaatagctggaccgggtgctgcaaaaacaaattgccgatggcgatctggacaatccctgtcaaaaagcctgtcgtaagcccggctttcactccccagcggaatgaaatcaaaaaaatcggaatcatcataatagagaccgaaccgccttggggcatccggagaaacatacctgagacaatgtccagaatgacagccgccccggtcataatcgctatttcaattaagcgcacaagccgtgttgaatgattcatagttttccccctggtcagacaaccgtaacaaggataaacaaaaaagcagcgcggggaaggatgggaaaaggtccgcgcgctgcttgcataaactgcaaatcatttggctttgccacatccctacgccagcgttaactaacaggttcaaagggtcagaacaaaatgttcactctcagctttaatgctccccttgtggtcatcaagtatttagttcaatcttactatacaagaaaatatgccaaaccacaagacagcttatctttctatagaagagaaactgaaataagtattaaagaaaataattaatgatttttttaaaaaaactattgtcatattttcaaaagggtgttatattattaaacgtcgctgatgaacaacagacaacaacgaaaagcttcgcaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattccttcaaaacataggaacacctgctaaatgcgccacttcctgtggcaacgcatgtgttagcacgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagccattacacgcaagtgtaatatacggaggattagctcagctgggagagcatctgccttacaagcagagggtcggcggttcgagcccgtcatcctccaccattcctatcatacataagttggcgtattaagccggtgtagctcaattggtagagcaactgacttgtaatcagtaggttgggggttcaagtcctcttgccggcaccacctttatatgttatactatataagtctcttgtaataagagccattagctcagttggtagagcatctgacttttaatcagagggtcgaaggttcgagtccttcatggctcaccatgtttttcttgcggatgtggcggaattggcagacgcgctagaatcaggctctagtgtctttacagacgtgggggttcaagtcccttcatccgcattgccaaacgcggaagtagttcagtggtagaacatcaccttgccaaggtgggggtcgcgggttcgaatcccgtcttccgctccaactatactataccatccatgccggggtggtggaattggcagacacacaggacttaaaatcctgcggtaggtgactaccgtgccggttcaagtccggccctcggcacttattgttgcgcccgtagctcaattggatagagcgtttgactacggatcaaaaggttaggggttcgactcctctcgggcgcgccatacatacttttgaaaaacgggaagtagctcagcttggtagagcacatggtttgggaccatggggtcgcaggttcgaatcctgtcttcccgaccattttggggccttagctcagctgggagagcgcctgctttgcacgcaggaggtcagcggttcgatcccgctaggctccacttgattttaattgttttttggcggtgtagctcagctggctagagcgtacggttcatacccgtgaggtcgggggttcgatcccctccgccgctaccattggacctttagctcagttggttagagcagacggctcataaccgtccggtcgtaggttcgagtcctacaaggtccaccacttatacggaggaatacccaagtctggctgaagggatcggtcttgaaaaccgacaggggtgtcaaagcccgcgggggttcgaatccctcttcctccgccatatctaatttaattatcatcgcggggtggagcagttcggtagctcgtcgggctcataacccgaaggtcgcaggttcaaatcctgcccccgcaaccaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttaatttaatattgttttggcggttgtggcgaagtggttaacgcaccagattgtggctctggcactcgtgggttcgattcccatcaatcgccccaaacaacatgcgggtgtagtttagtggtaaaacctcagccttccaagctgatgtcgtgggttcgattcccatcacccgctccatttttatattgtcatgggcctgtagctcagctggttagagcgcacgcctgataagcgtgaggtcggtggttcgagtccactcaggcccaccatgatgattttccacagtagctcagtggtagagctatcggctgttaaccgatcggtcgcaggttcgaatcctgcctgtggagccatacggagaagtactcaagtggctgaagaggcgcccctgctaagggtgtaggtcgtgtaagcggcgcgagggttcaaatccctccttctccgccataaggcccgttggtcaagcggttaagacaccgccctttcacggcggtaacacgggttcgaatcccgtacgggtcattaaaaaaaccttgcatactatgcaaggtttttttattatgcgttcatagtgtaaatggtaaaagacaggtatgtggcaaaagcgctccataataaataagggaccagaagccaggctgaagctttactgtatttaccggcaatgagcaacagaatgagtgttgtcacagccacaagcaggcaatcgatagatgcagcaagcaaatttttctgtgtgaattgaaaatagctgaatccttgattcacgatataattgatgagaagcatcacccaaaaagctttggattctttacatgaaaactttgggtatatcaaggctgctgagagcgaaataagcgcaaacaaaaccgcccatatgatgccgatcactgatccgctcggcgtccagtcagttttttgcagcgcgtcataccattcacggtcgatgggaaagagaacccccgctaaagaaaacaagacatatgtaatgataaatacaataatcgcaccgatatacttctttttcatttgttccctccgtcattcaatgtcaatacgttagttcccttttttggaaatattaaaccttttaaaaggttcatgcatcattaagtgtatgagttttcagtgtaaaaatgcagcaaaccatttatttgtattcaaaaaccccggcaggccggggttttaatcagcatgaagatcgccgaaggtcgtcataattccttgttcgtccaattcctgttcatatttttcgtgtgctttgcttggatacacggaaatgtttttgccggtaatatctgtcgcgataaagttttcataatcctcagcatagccgatgttttcttccgagttcattgtcatatccccatagctgagcggaggatcctctaaatcctgaggcgtttctgagtttccgtattcctcaacatcctgataagcatcttcactatcgtaagccgcccggattgattcatcatcatcaaattcaaactgtccgaacggagtttcctcttcaatcggcctgtctttggaaacggcatcctgcgaggaatattccgccaatgtcgtagccgtcggcagagcttcgagtctgtcataaggaatgtccttgccgctgacttcacatgtgccgtatgtgccgttttcaatttgtttcagagagtaatcaatatcgcgaaggtgctctcgttcatggtcgagcagagccaggtctttttcccgctcgtataattcggtcgcctgatcgccgggatgattgtcataggaagacaattcgccggatgactgatacgggaattcatcagttaactgaaatttgtcattttctttaaagcggcttaaaatatcatgtctggcttcttctaattctttttttaagtgtgtaatctgttcgtttgtaagcacatcaatccctcgtttctatgtgatacttactgttagtatgaacgcttttgcgcagaaaaatggtggataaaaatagtcattttcccatgaggaagtaaaaggatacagtgattgccgagagtggggaaagaaaattcaagtttgtttctttattcatttgcgcaaaaaggtttataataagaaatgcaggcattttgtcgtgctcacatctgtgtgtttgacacaaagtcatcacaggtgtattgtattaaaagcatttaacggattatggaggaatgtctcatggtgacaacggtgcagcatacgttccgagaggaagcagatcatgcattacataaagccaaacaagtcaaccatgctgtcttattgagctattcaagacgtattgcgtctttagaccctctatcatttttcaaagacggagcaaaaaaatataaaggcaaacgatttttttggtcagaacccggtagtgaattaacaatagtcggtcttggcacagaagcgctgttccaatcgaatgaaaaaaatggaaagcgttatcacgacgtttttgaacaatgggagcgctttaaaaagacggcttttcatattcatgaagaagaagaggcggcgcataccgcggtcggccctgtcttattcggcggtttttcatttaatcctgctgaagagagaggagacgaatggaacgggttcgaagaaggactgttctttatcccctcactcatgctgacaaagacggcagatggtgattatttaaccgtcaatcaatgggcggcagacggtaatctggcagaagatacgctgaaacgtctgaaatctttttcggaagctttttcagtttcttcaatcgagtatgaagaatatcctgttttaacaaaagcggaagaacttgatgtggaaaactggcttgaagccattaaaacagcaacaaatgatatgaaagcaaatcaatatgataaagtcgtgctggcaagggaagtcgttttgtcatatgatgggcctattccggcggagagcgttgtccgcaagcttttgacggaccaaacgacaagctatgtttttgcgattgagcagggagataaatgctttgtcggcgcttcaccggaacggctgatcaaaaaatccggcaaagacgttatgtccacctgtctggcaggttcaattaagcgcggagaaaatcaacaagaagatgagcgtctcggcaaagagctgctgcatgacgaaaaaaatctcgcggaacatgattttgtggttcagatgatacacgattctttcttgtcgagctgcagcgatgtgaaaaagcctgcaggtccgcaattatataaaacaaaaagtgttcagcatctatatacaccgatcacaggccatcttaaaacgtccgcttcgctgtttgatttaattgaaaagctgcatcccacaccggcattgggcggagctccccagcagaaagctgttgaagttatcgctgatattgaaccgatgacacgcggatggtacgcggcaccgatcggctggatggacggcagggaaaacggagaatttgtcgtggctatccgatcagggctgattgaagacaaaagtgcgcggcttttcgcaggctgcggcattgttgaagattcagatccgcaatcagaatatgaagaaacacaaattaaactaaagccgatgatctctgctttaggaggtgaaaggctttgacaaacccgattacacattatatcggaagctttattgatgaattcgctctatcgggtgtcaccgacgcagttgtttgcccggggtcgaggtcaactcccttggcggttttggcggcggcccacccggatattcaagtccatatacagattgatgaacgatccgcaggttttttcgcactcggtcttgcaaaagcccgccagcgtccggtcatgctgatttgtacgtcaggaacggcggcggctaacttctatccggccgtgattgaagctcattattcaagagtgcctcttattgtcctgactgctgaccggcctcatgaattgagggaagtgggggcgcctcaggcgattaaccagcattttctgttcggtaactttgttaagtttttcacagactcggctctgcctgaggaaaatcctcaaatgctgagctatatcagaacattggccggcagagccgtaagtgaagccgggaagcgtccgatggggccagtccatatcaatgtgccgctcagagagcctttgatgccggatttatcagccggaccttttgaaagaatgagaaaggggcggcacgtctcagtcacaacagggattcagtcagctgctcaagactctctctgtcatattacagagcgtctcgcgggtaccgaaagaggtatgatcgtctgcggcgaaattcacggtgaagcagaaaagcagcaaatcatcgctcttgccgagatgcttcagttcccgattttggctgatccgctttcaaacctccgaaacggggagcatgataagacgctgattattgatgcttatgactcgtttttaaaagatgaagaaataaaagaggcgctgcgcccggacgctgtgatccgcttcggcccgatgccggtttccaaaccgctctttttatggctcagagatgatcctgccattgagcagtttatcgtcgatgaagacggaggatggagagatcccacccaggccggcgcgcatatgattcattgccatccgtctgtgtttttggaagcggtccgttcagctgaaaccggaaaacggccgtccggatggcttgaaaaatggcagtttgtcaatgagcggttccggagtcatttacaggccgcgagcatggatgatttatcatttgaaggaaatgtatatcgtcagcttcagcaccttgtccctgaaggcagttcgatttttgtcggcaacagcatgccgattcgcgacgtggatacgttctttgaaaaacaagatcgttccttccgtgtttatgccaaccgcggcgctaacggaattgacggagttgtctcctcggctatgggactgtgtgaaggtacaaaagctcctgtcacgcttgtcattggagatttatcgttttaccatgatttaaacgggctgttagcggctaaaaaacttggaattccgcttacggttattttaataaacaatgatggcggcgggattttctcgtttttgccgcaggcatctgataagactcattttgaagaactgttcggtacgccgacgggtcttgatttccggcatgccgccgcactgtacggcgggacgtatacttgccctgagacatgggaagcatttaaggatgcgtatcagccgcaggcggacaagcccggacttcatataatcgagctgaaaacagatcggacatcaagagttcaattccatcgcgatctgctgcaggccgcagtgcgggaagtgaaaaaagaatggaaactgtaacagttaaaacggccgacggcgtatgctatcgtgctgctgatagcggacacgaatcatctgaagctattgtttgtctgcatggatttacgggcagcaaagaatcatggatgtttttacgcggcatgtttcccggcgaacgaatggtgatgattgactgcctgggtcacggggagacagacgcgcctgtgcaagcggcaaggtacagtgcgagccggcaggttgcggaccttgccgccgtttttgatcaattaaaacttcacaaagtgaaacttattggttattctatggggggaagacttgcgtattcctttgcacaggcatttccgcatcgggtgtcagcgcttgttttggaaagtacaaccccgggcctcagcacgcttcaggaacgcaaaaagcggattcagtcagaccggaagcttgctgactttatattgcgggaaggtataacatcgtttgtcgattattgggagggcattccgttgtttgccacgcagctttctctgccggacagcgtaaaggcgtccatccgtgccggcaggatgaaaaataatccgtccggacttgcaggcagcctgctcggaatggggacgggctcacagccttcctggtgggaggcattacaccgcatcaaagcacccgttctgctcatatgcggtgaatgggatgaaaagttttgcgctattaatcaaaaggtgcataacctgctcccatcaagtaaaatagaggttgtcaaacaggcggggcacacggtacatgtggaacagccgcgaatttttggtaagatagtaagtgagtttttatacggcttgtaaagcataaagaaaatagcttttcggccggactcaggcaaaaatgaaggaggtcatatcaatggctgcagaatggaaaagtgaacgtcagtacgatgaaatcctgtacgagacgtataacggtattgcaaaaataacaattaaccgcccggaggtacataacgcatttactcctaagacggtatcagaaatgattgacgcgtttgcttgtgcgcgtgatgactccaatattggtgtcatcgttcttgcgggagcgggagataaagcattctgttcaggcggagaccaaaaagtccgcggtcacggcggatatgtcggagacgatcagatcccgcgtctgaatgtgcttgatcttcagcgtttgatccgcgttattcctaaaccggtcgtagcgatggtatcaggctatgccatcggcggaggccatgtgcttcatatcgtctgtgatttaacgattgcggccgataacgcgattttcggccaaaccggaccgaaagtgggaagctttgatgccggttacggctcaggttacctggcgcgtatcgtcggacataagaaagcccgtgaaatttggtacctgtgccgtcaatacaacgcgcaggaagcgctcgacatggggcttgtcaatacggttgtcccattagagaaacttgaagaggaaacaattaaatggtgtgaagaaatgcttgagaaaagccctacagcccttcgtttccttaaagcggcatttaacgcagatacagacggcctcgccggaattcagcaatttgcaggagatgcaacgcttctttattacacgactgacgaagcgaaagaaggccgcgattcctttaaagagaaacgcagtcccgatttcggtcaattccctcgttttccgtgatcagatgacactacgaaacagcttgagccgctctggtccaagctgttttcttttcaaaaacagtacttttacctcggagatgataacatgctgacagaacagccgaattggctcattcaaagggctcagctgacaccagagagaatcgctctcatatttgaaaacaaacagatgacattcagagaattatatcatgcttctaaacaaatggccgcgcggctgtccaaatactgctcgcttaaaaaaggagaccgggccgcgattttgctttctaacagaccggaaatggtttatgccgttcacgcctgcttcttattaggggcggaagctgtgctgttaaatacgaagctctcaaaacaggaacggttgtttcagctcgaagattcacaggcaaagcttttattgacggaggacggtttttgccgcgaagattatgaatctgcagtcgccgctgcggacgtggacgagctgcaggccaaagccgcgggagacattgaacctgaagcttatgtaacgcttgatgatacggcgactcttatgtatacgtcaggaacaacgggaagaccgaagggggtgcagcagactttcggtaatcattattccagcgctgtatcgtctgcgctgaatctgggggtcacggagcgggaccgctggcttattgcgctgccgctgtttcatatcagcggtctgtctgcgctgtttaagtcggtcatttacggcatgcctgtcgtgcttcatcaaaaattttctgtcactgatgtgctggacagcatcagctcccatcaggtcacgatcatttcagcggtgcagaccatgctttcgggcctgcttgcggaaactgaacaatgtcctgaatcactgcgctgcattctgcttggcgggggtccggcaccgctgccgctcctcgaagaatgccgcaggaaacaatttccggtattccaatcttacggcttgactgaaacctgctcacagattgtcacgctttctccggaattcagcatggacaagctcggctcggccggtaaaccgctgttttcatgcgaaattagaattgaaaaagacggaaacccttgtgcgccgtttgaacacggtgaaattacggtgaaaggcccgaatgtaatgaaagggtattaccatcgtgacgacgcaaaccaggccgcttttcataatggatggtttaaaacgggcgatcttggctatttggatgatgaagggtttttatacgtgctggacaggcggtcggacctcattatttcaggcggagaaaacatctacccggcagaagtggaagcggcgctgcttgcccatccggctgtagcggaggccggtgtttcgggagccgaagatccgaagtgggggaaagtgccgcatgcttttctcgtgctgacttcttctgtcagttctgaggagctgaccgccttttgccgtgagcggcttgcaaaatataaaataccggctgcttttttcgaggttgacgggctcccgcggaacgcgtccaataaactgatgagacatcggctgaatgagcttcgtaaaggagaattgtcatgattaagattgaaaaaatcaccctttatcatgtaagtatgaggctgaaaaaaccgtttaaaacaagtattgaaacgctgcaggatcgtaaatttttgatcgtggaagcgatcgatgaaaccgggagaaccggctggggggaggtatcggcgttttcttctccgtggtatacagaagaaacgattcagacatgcgcgcatatgctgagagattttttcatcccaaatgtcgtaggccgcgagtttttccatccgtcagaagtgcctgacagtctcgcgcgtttcaaaggaaaccgcatggcaaaagcggggcttgaatcagccgtgtgggatctatatgccaagaaaaaggggatatctctcgcagaagccttagggggcaaaagagataaagtgcccgccggcgtggcggtgggtctggcttcggctgatgagatgcttcgggaaattgagcaatacgtaaaagaaggttatcaacgtataaaaataaaaattcagcccggccatgacgttgatctggtcagatccatccgcagccgttttccgaacgtaccgctgatggcggatgccaactcggcatatgaactgaaagacatcagcaggctgaaagagttggatgaattccagctcatgatgatagaacagccgcttcaggcagatgatattgtcgatcaccgccacctgcagaaacacttgagaaccgcggtatgccttgatgaaagcatatgctcatatgatgacgcaaggcgggcgattgagcttgggagctgtaaaatcattaacataaaaccggcgcgtgtaggaggcctgacagaggctttaaaaatacatgacttatgcagagagcatcacatgccggtttggtgcggcggaatgtttgaaaccggcatttcgagagcgcagacagtcgcgcttgcttcgctgccgcaatttacgataccgggtgatatttcctcatcagaccgatactgggaggaggatattgtcactcccgacatacgtatcgaagagggattcatctctgttccggacggtcccggactgggtgttgaagtcaatcaggaaataatgagaaaatacgtcacccaaatggacgtttttacgacaaacaactgataaaaagacatttcagcgagttgagctgcctgtatgctgctgttatattgaaattgttcattatcaccccttcccccgtttgaaccggctgtatcagccggtttttttaataggcggatgcgatgatttttttattcttcaaacagtgtcggctttacatcgcaggtgttgctttctggctgggcaaacatgtacatcttgataaaaaattctgtgcttgtcatgaatgcgatactgatcgtaccgtctgccgcctatatttgccgacgaaccgcctttctgccatgcttctcatccgcgcgattttccccggctcaagggctgatttcaaaaaggcttgcggcacggaaatgaaaaagagctgtataaaacagctcttttcttttataaatcatgcggtttaaaggttttgcaatccgtttcttcacttttttcagcggtttcgcctgtatggctgaccacataaatcgcgtcggccgtgcatttgtttcctctgccccaatatgaacagttattgacttcacacagaattttttggtccatgctggctcccctccaagataaaaggtacgccattagtatgagccgccctgatttttgttattcctcctggcggatataacgtctgtctttcataaagagcttccagaagaaataaaacccgggaaacaaaatgatgaaagcgacgatatacgtcataaacagcgccctgaaggttgccggctccgtaaatcctgacatgaccgtaatatccggataaatcatataaggaagatgcgcccgtccgtatgcatagcttgccagaaagtattgaagcgcaatggcgatcatggcgattctcggtttgccgaggttgcggccgaagcgcttattcggcaaaaacagagccacgccggcaatgataaatgtgatgacagacagaatgagccatgtcttgtctttcatcatccccgtatacagccagccggcttcagagcgtaatgtcagcataatgaagaaggcgaaaagaagcgacagcggccctgttagtaaagagctccgtctgtagatgcggtacgcatgctcctcttccgcaacatttgaaaaatcggccagaagcagtgaagataaaaataaagtgcttaaaatggcaaagccgataaacgcatacgcattaaggcttgtaaagacatttgccaaattcagttgatacactccgcccgtcttctcaataaaccctccgtgtgtgaccggaaggaccaaaatcagcacagcgggaataatgaaacctgaaattccggagatatatctcatgatttttctttccttcgccgtattggagaagacgagaaagccgctgcggatggctaagagcagcaaaataatacttcccgggatcaataaaacggttcccagcacgaaggttgcccctggaaagaagctgaatagggcgacaacgatcgcgacgataaagacgttggtcacttcccatgtcggggacaaataacggttggcgatgtttgtcgcctttgtttgttctctatttaaataaatcatcgaccaaaagccggctccgaagtccatcgttgccatgaccgcgtagataaacacgaagccccatacgattgatatcgcaatgagagcatccatggtaatgtccattttaattcagccctttctatagttaggattccgcagcttttacatcctcctcaacgggatgtttgcggaaataataaagcagcacataaatgactgcggctgccaaaatggcgtaaaccactgtaaacaggatgaacagcaaaccgattgaaccggttgtcgtgacgacatcagacgttttcaggagatggtaaatcacccatggctgccgccccgtacaagcgaatatccacccgaattcaattccgatcagactgagcggtcctgcggttaaaaataaaatcaaaagccaagtcggaaagctgtctttctttaaaatttttctccacacgatgccgatgattgagtacaaaatgagcagcattccgatgccgaccattccgttaaacagtgtatggatgaataaaggcggccactcgtctttcggaaacgcgttcaatcctttgacgacggtatcaaagctgtttgcagccaaaaagcttaaagcccacggcacttctatcgcccattttactttttcttcttttgcatcagtaaaacccccgatcgcaagcggagcgtgtgatctagtttcaaacagcccttctgcgcccgcaagcttctcaggctggtattcgtaaagaagctgggctgactcgtgaccgtttaaagaggcaataatggagaatatcccgccgatcgttaaggcgagcagcagcgcttttcggtgaaagcggtatacctgctcctgttttctcgttctcagcattttataagccgcaactgacgcaacgataaatgcaccggtcatgaaagccgtcagtacgacatggcccgcggtggtgaaaaagcttggattaaaaaacgctgcccaaggttcgacgtcagtgattttgccgtttaaaattttaaagccggccggcgttccttcaaatgcgtgaacatttgtgattaagacggcagatgccgcggcgccgatcaaaacgaaaataacggcaatgatgcgcatcgccggagtcagccggtcagcggcgtagacataaatggacataaacagcgcttcgataaagaaagcataaatttcaatctgaaacgggagtgacatcaccctgccgatgacttccataaatccgggccacaaaagggcaagctgtgtacccgcgatcgttccggtcggtatcgccacgccgagcagaacagcctgcgccttcgtccaccgttttgccataatggcataatgcggatcttttgttttttggtaaatcaattcagccattaaaatcatcagaggcaagccgacaccaagcgtcgcaaaaataatatgaaagcccatggttgtaccgaacaggcttctggctaatactaaatcatccacgatcataaaccgcctttctaaattaccgttttatgtaatgtggctatattatttgctgaagcgattagattattcttccgattccatatatgtgcagggtttagaaatcaagggatcagggcatatatgattgacaagcggatatttaaggcttaaaataaaacgtaattattacgatttgagaaagggagatcagcatgaaaaaagatattcatccggataaccatcaagtgatttttcaagatgtgaacagcggctatcgctttttaagccattctacgaaaacgtcagcggaaacggcagagtgggaagacggaaaaacatacccgctgattaaagtggaagtcagctcagatacccatccgttttatacaggccgccaaaagttcaacgaaaaaggcgggagagtcgaacagttcaataaaaaatacaatatgggaaaataagacaagcccaatggggtttgtcttatttattgagcactttgtcatctcgtgcggggagtgacgaaatgacccgtcttatgttatattgtgaataaaaaagcagaaaggaaacaccaagatgagtcttctaaatgatatcatgcaatttaatgagcagttcactaaaaacaaagattatgaaaaataccaaacatctaaattcccggataaaaaaatggcgattttgtcctgtatggacacacgtcttgtagaattgcttccgcatgcgatgaatatgcgaaacggcgatgtgaaaattattaaaagtgccggcgcgcttgtcgcccacccgttcggaagtatcatgcgcagccttttagtggccgtatacgaattaaacgccgatgaagtctgcgttatcggccaccatgattgcggcatgagcaaaatcaacagcgaggatatgctcgataaaattatcgaccgcggtattccgaaagagcggattgacatgctgaagcactcaggagttgatcttgatcaatggctgaaaagctttgattcagtagaagcgagtgttacagacagcgtaaacgtcattaaacaccatccgctattccctgacaatgtgccggtgcacggtctggtgattgatcctgaaaccggtaaacttgatctggtgatcgacggctaccagcatatggactaatgtttttcttttttgtccggtacgggatcaacaccgcccggatgaaaagggtggcactttaaaatccgcttcagtgtcagccatccgccttttaatgcgccgtgagtcttgacggcttcgattccgtactgcgaacacgtcggataaaagcggcatgacggcggcgtcagcggagagatgaacttctggtatccgcggatgaaagcaatcattatggttttcatcaaaaaaccacctttctgatgctagtatagaaaaaaaatttcagattgaaaagcttccgtcacaattcttatcggaaaactgtgttataatggatgcatattctgaaaaaaagggagtgccattatgccttcagtagaaagttttgagcttgaccataatgcggttgtggctccgtatgtaagacattgcggagtgcataaagtcggaacagacggcgtcgtgaataagtttgacattcgcttctgccagccgaacaaacaggcgatgaagccggataccattcatacgcttgagcacttgcttgcgtttacgattcgcacacattctgagaaatacgatcacttcgacatcatagatatctcaccgatgggctgccagacaggctattatcttgttgtcagcggcgagccgacagcggaagaaattgtagacctgcttgacgctacgctgaaagaagccatcgatattacggagattccggcggccaacgaaaaacagtgcggccaggcgaaacttcatgatttagaaggcgcgaaacgtctgatgcgtttctggctgtcacaggataaagaagatttgctgaaagtgttcggataaaaaacaggcctttttgctgacatgcaaaaaggcttttttacatatttctaaaaaatgtcacaccttatgtgtaagcgtttgctaaaatagaagcaaacatgaaggagtgatgggatgaaacgggctgtattggcaggtatgtgcggtatggtatttctattatcttcctgcgggggcaattcggacaaaacctccgcggatgaagagcctaaagcgcttgaggtcaagcttacaggaccggaaacgactgcaccgcatgaaaaagcggaatacaaggcggaagttttttacggcggcaagcgtgtcacggatgcggatgaagtcatgtttgaagtatggaaagaaggaaaaaaaggcagcagcaaaacaagcaaggccaaggaggaaaaaggggcgtatcacctgcggactgaatttgatgaagagggtgtgtataccgttcaatcccacgtaacggcaaaacagcagcataatatgccgactgtaaaagtgcgtgtcggggatgctgaagctgccgatgattcctccggccatgaggaacagacgcatcatcattaaggattttttttatccgtcaagccttttgatgcgtcctccggcgggtcaatcgtatgttttacattataagctcttacagtcgaccagatggataaaagcagcacggcgagcacgataagaaagccgaagctcagaagaagcagcatgaaatccctcctttttaacaaatcataacatattttccatccgtaaaatcaagggctaaaaatttatgttttaacacacgatatatagggtatatcaatagtaaaccaaaggaggaagataggcatgtcagaaaaactattggatgcagtcaataagcaagttgcaaactggacggtcatgtatgtgaaattacataattatcattggtacgtcaaagggaaggactttttcacattgcatgaaaagttcgaggagctgtataacgaaacggctacatatattgatgatctggcagaacgtctgctggcattaaacggcaagccgatcggcacaatgacggaatcattgaagacagcgtctgtaaaagaagcggaaggcaatgagagcgcagaacaaatggtacagaacatttatgatgatttcactgtcattgcggaagagctgaaaagcggcatggatctcgcagatgaggtaggagacgaaacgaccggtgatatgctgcttgccattcaccagaatatcgaaaaacataactggatgctgaaagcgtatttgggataatcaacaagggaagaccggggctataaagcactcggtcttttatttggctgccgaagagaggtgttgtccatttttctgaaaaatccagtccgttccattcacttttcatagaataatgtaaggccgtttctgtgaaaggatgttggatcaagtgggcaaagactttggcatcttttcgttttttgcagtgatcgtgtcggcagcggggtttttcttcggaggttttcagtattcgtttctgattttgctatcggtcatggcgattgagtttatcagtacaagcttaaaagaatctcttttgcagcagctgagcgcaagaaagctttttgcgcggctggtcaaaaaaatcgtgaccctggcattagtctcagtttgccatttttttgaccagctgcttcataccgaaggcgccatccgtaatttggctatcatgttttatatcttatacgaatcggttcagatcgtgattacggcaagctcgctgggcataccggttccgcaggtgctcgtcgacctattggatactttgaaaaataaattcaagcgcaaaccgtaacatttgcttcaaaggaggctatactagcgggtatgatggttttcctctgaatttttgataaagggcttccgaacaaacgcaactgtggtatgatgtatggaagatatgaaggaacggattagagggataaacatgtacgagtttaaagactattatcagaacactgttcagctctcctttgaacaccagcctttttcagacagcccgaagcacgtatgggtcatatgccgatatggagataagtggcttttgactgagcacgaagaccgggggtttgaatttccgggcggaaaagtggagccgatggaatgtgcggaggaagcggccctgcgcgaggtgaaagaagaaaccggcgccgcggtaagacatctgaagtacgtcggacagtataaagttctcggcagggaaaaggtaatcgtgaagaatatttattttgccgatattgaaaagcttgaacaacaggctgactattttgaaacaaaggggccggtgctgttcagcgaactgccggagaatctcccgcgaaataaaaaattcagtttcattatgaaagattcggtgcttccgatcagtctgaaaaagctgaaagaggacggcgtatttcaatcataaaaacgaagacccggcgtttacgcacgggtcttttttaaatttttcctttcgtccattttctttctaacagttcgactccctgatacatcaatgtcgcaaaaatcgcgatgatcagaaggcttaagaacacaagagtgaaattgaagacctggaatccgtaaatgatcatgtagcccagacctttttcggaaacgagaaactcgccgacgatgacaccgacccaggataaaccgacgttcactttaagcgcggaaataatcgcgggggcgcatgccggcagaatgacttctttaaacatgatgcttcttttcgctccgaaggttttcatcaccttaatatagttttcatccacttcctgaaaagccgtaaagacgacgattgtcgtgataatgacactgatgactgctcccatggcgacaatgcttgtgaaattcggtccgagtgccacgatgagaatcggtccgagtgcgaccttcggcatcgcgtttaaaatgacgaggtacgggtctaaaacccgggcgagcctgtttgaccaccataacaaagcggcgaggcatgtgccgaggagcgtgccgagcaaaaagccgagaacggtttctcctaaggttacgccgatgtgcgccgcaagggatccgtccgcaatcttttcaactaaaagcctgcaaacggcggagggtgagctgaagattaacggatcgatccagcccgccctgctcgatatttcccagccggcaaaaaatacgatgaaaatggcggcctgatacgcacggatccggagcttttctttttggtgtcttttcttaaactgctgatgaagctgttcaatcgtgccgctgctgtttttcaagggaattcagctccttccatatggtttgaaacagcggctgaaaggccggatcctgacgcgcgtcaaacggatctaaagccgcgagctccttaggcacggtgaatatttggtggatggtgcccggctgattcgaaaataaatagatcgtatcgctcatggcgatggcttcaccgatatcgtgggtgacgagcacggcggttttttgaaaatcctttaatgttctgaagacaaggttttccaaagaaagcttcgtttgaaagtccagcgcggaaaacggttcatcaaggagcagcagtcccgggtccggtgcaagagttctggcaagtgccgcccgctgccgcatcccgcctgacagctctttcgggtatttcttttcaacgccgattaatccgagcttaggcagaaggctgagaacttcagctcttttttcttctgttaatgtttttgaaatgtgtaaaccgagcagcacgttttcctcaattgatttccaaggaaataaataatcctgctgaagcatataaccgatttggtgttctttatggttcggcacgcttccttcaatcagcacccggccttgcgcaggggtgataagaccggccagaatggacaggagtgttgtttttccgcatccgctcggtccgagaaaggagatgaaatcccctttttcaatctgaaaatgtatatctttcacggcggttgtcttttctttcagcgagaaataagtatgtgttacatgatccacatgtaaaaaagacattcatgttcctcctattgttctgaggtgacttttttggcgatttttgtgttgacgagtttgctgtacggaatgtgtttcggaagctctccggcctcatccataatagattgaagctgttcccattcatccttttgcagaactgggtctgcagagaatgacttttgttttttatatcgctctattgatgtttcgataatggccggatcggtatcggcaaattccttctgaatcgtttttgcgatgtctttggccggatggctttccacccattgctgggcgcgatagatggcgcgggtgaatttttccgccgtcttttcattggttttcaaataactttcttttgccataaaggttgtgtatggcatttggccggaagcttctccgaaggatgcgacgatatggccgatgccttctttttcaaattgggatgccgtcggttcaaacagctgcacataatcacccgttccggatgcgaatgcgttggaaatattggcgaaatcaatgttttgaacgaggttaatgtcttttttcggctctatgtgattctttttcaggacgtactcaccggccatttggggcatgccgccttttcgctggccgagaaatgtttttccttttaaatcgctccatttgaatgatttctcatccttccgtgacacgagaaatgtgccgtccgtctgcgtcagctgcgcgaagttgatgaccggatcttttgctccctgcgcctccacgtaaatggatgtttcagaaccgaccagcgcgatatcagacccgtttgacaaaagcgatgtcattgttttgtctccgccccatgttgtttgaagtgacacttggagcccttcttttttaaagaaaccttttgcttcagcgacatacagaggcgtatagaagatggagtgtgtgacttccgccacctttacctttgtcagactttcttcctgtctgcaagccggaagaatgagcaggaaaaaggcgcatatgacaaaaacgcagcccgttttgagccatttgttcacggtgtaacctccttgttttaagcgttaaaataaccttttctgctttacatatcgtatgatgggtataaaaaatgtgtgagtgcccatattcaggttgggaaagaataaaaaaactgatgatataaggaggccattgttttgctggcagaaaagaaaaggttcccgtctccgagtccgcatatccgcctctttgaggtatgctatgagtcagaagggctgaaggtaaaggggcttcttgccgagcctgcggcgccgggaacatatgacggttttttatatttgcgcggcggcatgaaaaatgtcggcatggtacgccccggaagaatcgttcaattcgcttcccaaggctttgtcgtgtttgcgccctattacagaggcaaccagggcggcgagggaaatgaagattttgcgggagaggacagagaggacgcgttttccgctttccgcctgcttcgggagcatccgaacgtcagagaagggcgggtgcatattttcggattttcccggggcggaatcatggggcttttgaccgcgattgaaatggggcatcaagcggcttcgctcgtatcatggggcggtgtgagcgatatggtgcttacttatgaagagcggaaggatatgcggcggatgatgaagcgggtgatcggaggcacgccgaaaaaggtgccggatgaatacagatggcgttcgccgtttgaaaaagcagaccgcattcaggcccctgtgctgctcatccatggagagaatgatgagaatgtttcgatcgaacacgcccgaatgatcgaggacaagctgaaagaggcggggaaaccggtggaaacttggtattacagcggttttacgcattattttccgccgcaggaaaacagacgcattgtccggcggctggcggaatggatgaagacacggtaagatgcctgatttatgatatgataataaagaataagagaatgaaaggggattttcattttgggaatgcctgttgaatttaataccatgattgtgacaaaaggcaatgaaaaacggatagaggaaaatatctttttattggagaaagagggctaccgcgtctatcctcttgatattccgatggacgtgcgcaaaacgaaaaccggcgagaaatccggcaccggcgaggtccaaaagctcgaatgggcgaacggccggacaagcattacatacagactcacgtcgctccattcgacaaactgaaaaaacaaaagccgagggcataaacgcccttggcttttttgattacacgagaggtccgccggctttggcaatcgagtccgcatgggaaaactttttaaagttttctttaaactcattggccaaaaacagcgctttttcgttgtatgcttgtttatcgctccatgtgttttcaggctgaagaacttcatccggaacgcccggaacatgaacgggactgcgcaggccgaaaatgctgtctgccgtcatgtcagtctggttcagtctgccttcaatagcggccttgaccatcgctcttgtatacgaaagtttcatccgttctccgactccgtaccctccgccggtccagcctgtgttgaccaggaagacttgaacgccgtgttcgtcgattttatgcccgagcatttcggcatatacatgcgccggaagcggaaggaacggtgaaccgaagcacgtcgagaaagtcgtttgcggagatgtcacgccgcgctcggttcccgcgagtttactggtgtacccgcttaagaagtgatacatcgcctgttccttcgtcagtttgctgatcggaggaagcacgccgaatgcgtccgccgttaaaaagacgatcgcctgcggatggccggcaatgctcggctgcacgatattgccgatcatctcaatcggatatgcggctcttgtgttttccgtgtagaaggaattgtcgtaatccgcttcacccgttttttcatcaagcacgacattctcaagaacagacccgaagcggatcgcacgaaaaatctgcggttctttttcctcgctcagattgatacatttagcgtaacatccgccttcaatgttgaaaacgccggaatctgaccagccgtgctcgtcatcgccgatcagtttgcggtccgcatcggctgaaagcgtcgttttccctgtgccggaaaggccgaaaaacagggcgacatcgcctttttcaccgacattggctgagcagtgcatcggcagtatatcctgctgcggaagcaggaagttcataatggagaatattgattttttcatttctccggcgtattcggtgccgccgattaaaatgacgcgcttttcgaaagagacaatgataaatgtttccgaatgcgtgccgtccgtctccggatctgctttaaaatgcggagctgagagaatggtgaaaggctgcgcttgcgtgtctctttcatccgtctccggtctgataaacagctggcgcgcgaataaattgtgccacgcaaattcatttacgaccgtaatcgggagtctgtatttttcatccgctcccgcgaatccttcaaacacaaacagttcatcccgctgttttaagtagctgacgactttggcgtacagcttttcaaacgcctcttcagaaatgggctgattcaccgcgccccaatcaatttgattttctgtgctttgttcacggacgataaatttatctttaggtgaccggcctgtatatgcgccggtggtggcgcgtacggcgcccgttgatgtcagcgttccttcatttcggctgatcactttttcggtaagttttggagccgataaattatgatgcacattcggacttgcaagtaatgcttgaagatctgcggttaaatcaactaatttcataaaaaccttcctttgccggtttatttgtatttcgctgaatgtggaattagtataacatatatctgaaaatagtctatactatttgcggttttttgtttgtgtttttccattgcttcccgaaataaaggcgcgtaatcgctttaattcatattgacactttccgcccttttacgataagatatttcattgagcggatactcttatcccgagctggcggagggacaggcccgatgaagcccagcaaccggtttctctgtaaaaaagcaggtgaaaacactgtgggaaaccaaggtgctaacctgatgcaaggtttaatattttccttgagcgataagagtgaaaggcacacagaccaaaccctttcctcgagtggaaaaggtttttttatttcataaaatatgccaattaacattctctgatatagtatgacattgtattaagagggagcgagttccgtatcatatgaaaaggtcttgcaaaagatcttttttcaggaggaaaagtgaatgagtaaaaaccgtcgactatttacatctgaatctgttactgagggtcatccggacaaaatctgtgaccaaatttctgacagtatcttagatgagattttaaaaaatgacccgaacgcgcgcgtggcctgcgaaacatctgtaacgacaggacttgtgctggtaagcggagagattactacatcaacatacgttgacattccgaaaacagtccgtgaaacgattaaagaaatcggctacacacgcgccaaatatggatttgatgcggagacttgcgctgttttaacatcaattgatgaacagtctgcggatatcgcaatgggtgtcgatcaggctcttgaagcgcgtgaaggcacaatgagcgatgctgaaatcgaagcaatcggagcgggagaccaaggcctgatgttcggttatgcgtgtaacgaaacgaaagagcttatgccgcttccgatctctttggcgcataaattagcccgccgtttgagcgaagtccgcaaagaagacattcttccgtaccttcgccctgacggcaaaacgcaagttaccgttgaatatgatgaaaacaacaagccggtccgcatcgacgcgatcgtcatttcaactcagcaccacccggaaattacgcttgagcagattcagcgcaatctgaaagagcatgtcattaatcctgtcgtgcctgaggaactgatcgatgaagagacaaaatacttcatcaatcctacgggacgtttcgtaatcggcggacctcaaggtgatgcgggtctgaccggccgtaaaatcatcgttgacacatacggcggatatgcacgccacggcggcggcgcattctccggtaaggatgcgacgaaggtagaccgttctgcggcatacgctgcgagatacgtagcgaaaaacatcgtggcagcaggtcttgctgattcttgtgaagtgcagcttgcatacgcaatcggcgtggcacagcctgtttctatttccatcaatacatttgatacaggaaaagcttctgaagaaaaactgatcgaagtcgtacggaataacttcgacctgagacctgccggcattattaaaatgcttgatttgcgccgcccgatctataagcagacagctgcttacggccacttcggacgtcatgatgtggatcttccttgggagcgtactgacaaggcggatgcgcttcgcaaagaagcactaggagaataattttatagccgcttacttaagcggctttccctttttgtagatgctgccatgcttattttttacatagcgtgaaaccaatggcgtaacaaagcgtctataaaaagggggtccaattagaaaattacacttatggaggctatactatgtgtggatttgtcggtgtttttaataagcatccattaactcaaaccgcagatcaagaagagctaatcaaacaaatgaaccaaatgatcgttcaccgcggtcctgacagcgatgggtattatcatgacgagcacgtcggattcggcttcagacggctcagtattattgacgtagaaaacggcggacagcctttatcatatgaagacgaaaaatattggatcatttttaacggcgaaatctataactacattgaattgagagaagagcttgaagcgaaaggctacactttcaatacagattccgataccgaagtgctccttgcgacataccgtcattataaagaagaagctgcttcaaagcttcgcggaatgtttgcgtttttaatctggaacaaagctgaccgcgtcatgtacggcgcgagagacccgttcggcattaaaccgctgtattacacaaccatcggggacaaagtatattttgcatctgaaagaaaaagtttaatggccgctcaaaacggcattgatcttgatacagcttctttacagcaatatatgtctttccaattcgttcctgaaccgagcacgcttgacgctgaagtgaaaaaagtcgagccgggcagccagtttacgatccgtccggaaggcgacatcgcgtttaaaacatatttcaaagcgaacttcaagcctgttcagtctgatgaagataaattggtgaaagaagtcagagacgcaatctttgactctgtcaaagtccacatgagaagtgacgtgcctgtcggttcgtttctatccggcggtattgactcttcttttatcgtctcagttgcgaaagaatttcacccgagccttaaaacattttccgtcggttttgagcagcagggcttcagtgaggttgacgtagcgaaggaaacggctgccgcgctcggaattgaaaacatcagcaaagtcatttctcctgaggagtatatgaacgagcttccgaaaatcgtctggcactttgatgacccgcttgcagatccggcggcgattcctttgtactttgtcgcgaaagaagcgaaaaaacatgtaacggtcgcgttatccggggaaggcgcggacgagctgttcggcgggtacaatatttaccgcgaaccgctttcgcttaaaccgtttgaacgcattccgtccggtctgaaaaaaatgcttcttcatgtggcgtccgtcatgcctgaaggaatgagagggaaaagcctcttagtccgcggctgcacaccgcttgaggagcgttatatcggtaatgcgaagatttttgaagagcccgtgaaaaaacagctgctcaaacattacaatccagagctttcataccgtgatgtcacgaagccgtactttacggaaagccgttcatacagcgacattaataaaatgcagtatgttgacatccatacgtggatgcgcggcgacatcctgttaaaggctgacaaaatgacgatggccaactcattggaactgcgcgtgccgttccttgataaagtcgtgtttgacgtggcttctaaaattccggatgaactgaaaacgaaaaacggcacgacgaaataccttctgcgcaaagctgctgaaggggtagtgcctgatcatgtgcttaaccgcaaaaaactcggcttccctgtgccgatccgccactggctgaaaaatgaaatgaacgaatgggttcgcaacatcattcgtgaaagtgaaacagatgcttatattgaaaaggattatgtccttcagcttctggaagatcattgtgccgacagagcggacaacagccgcaaaatctggaccgtgctgatcttcatgatctggcacagcatcaatgttgaaaaaagactggtgccggaagagctgaatcatcagccgaaagaagtcatttttgtttaatccaaaaggctttcgatgttatcgaaagccttttttctattgttttttgtaaaccgtctattccgctctgttttcgacaaagtattacgcaatattcagaaaaaggttataataggactaatcgggtagattccggaaagtgttttctggctatttcgtctcggtttgtgtttctttgtcaaaatcagggggagggagagttatgcaaaacaaagaaaaaacgcttcaccgcggcttggaagagcggcatatctcgcttatgtcgttgggcgccgcgataggagtcgggctgtttctcgggtcggcttctgccataaagcttgccggaccggggattttagccgcttacgcctgcagcgggctgattatgttttttattatgcgggcattaggggaaatggcgattcaaaagcctgtagccggctcattcagccggtatgccagagattatctcggtccgcttgccgggtttttaacaggctggaattattggtttttatgggttgttacctgcatggcggaaatcaccgcggtcggcatttatatgggctactggttccctgacgtgccgtcatggatctgggcgctttgtgcactcgtcattatgacggctgtcaactttctggcggtcaaagcgtacggtgagcttgaattctggtttgcgctcattaaagtcttggcgattctgtcaatgatcgcgatcggtctggtgatgatcggattcggcctcggaaacggaggcgttgcgctcggaatcagcaatttatggagccacggcggctttttcccgaatgggattaaaggggtgctgctgtcgcttcaaatggtcatgtttgcctatctcgggattgagctgattggtgtcacagccggtgaggtcaaaaatccggaaaaatcactggcgcgggccatagatactgttttttggcgcattctcattttttacgtcggagctttgtttgtcattatgtcaatttatccgtggcaggaaatcggttcaggcggaagcccgtttgttttgacatttgaaaaaatcggaatacccgctgcagccggaatcattaattttgtcgtattgacggcggctctttcttcctgcaacagcgggatcttcagcacggggcgcatgctgttcaatctggcggaacaaaatgaagcgcctaaagcatacggtacggtcacaaaaggcggtgtgccgggaaaagcggtattggtttcagcgggcgcgttatgcatcggcgttttgctgaactacgtggtgccggcaaaagtgtttacgtgggtgacgagcattgcgacgttcggggcgatttggacatggtcgattattttgctttcccaaatgaaataccgtaaaagcttacagccggaacaacggaaaaaactgaaatataaaatgcctttatatcccttttcctcatatatctcattggcatttctcgcttttgtcgttgtgctgatggcttttgatgcagagacccgggtggccgtcattatcggtcctgtctggttcggcatattattagccgcttattacgggaaaggtttccataaaagaaaagacataggtctggaaaacggacagacattcgccgaaaaagcgtaaaaaaagagcccgggacatgggctctttttttcataggatcgggccggcgggggaagaataaaacaaattcctgaacattttgcttctgtttcctgacaatcgggagaatgcaaatggtttttacttaaataatattttgaaaaatggtacagtagtaaaacaaagctgatctatttttatttctcttgcagtgttttatagtatcggcctttttcaacatattccgttctgattctttccatgtcccgtatgtcttcttctgtcagccggcggataacctttgcgggccggccgaacgcaagacagccgggaggaatggttttgcccggaggaacgagacttccggcgccgataaacgcgccttctccgatttccgccccgtcaagaatgacggagcccataccgattaaagcattctttttgatgattgcgctgtgcagtgtaacctgatggccgatcgtgacgtcatcttcaataagaagcgggcggttcggactttgatgcagacagctcaagtcttgtatgctgactctttttccgatccttgtcggcgcgacatccccccggatgacggctgagaaccaaatgcttgattgttctccgatcacgacgtcgcccgtaatgacggcgttatccgcaatgaacgcttcaggatgtatgtcaggcgtaaattgtttataagggtagattatcatgtctcatccttctttctctaaatttatgtaagaggtgaactgcatgtggacttggaaagcagacaggcccgtcggtaccattgtcattatccacggggcaagcgaataccacggacgttataaatggctcgttgaaatgtggagatcttccggatataacgtggtgatgggcgatttgcccggtcagggaacgtcgacccgcgccagagggcatattcgctctttccaagaatacattgatgaagtagatatatggattgataaagcgagaacgcttgaagcgcccgttttccttttgggccacagcatgggcggactgattgcgatagaatggtttaagcagcagagaaatccccgcattacggcactcattttatcatcaccttgtctgggtctgcaaataaaagtcaataaagtccttgattttgcgtctaaaggactgaacgtcctcgctccgtccctcagagtggattccggtttatcacctgatatggcaacgaggaatgcggatatgattgaagcggatcaaaacgattctttatatgtcacgaaggtatccgtaagatggtacagagagcttttaaaaaccattgatgccgctatggtgccgactgatgcgtttttaaaggtgccgcttttgcttatgcagggcggtgatgacaaaatcgtcgataaaatgaaggtccgcaaatggttttccggtgtggcttcccataataaatcgtaccgggaatgggaagggctctatcatgaaatttttaatgaaccggaaagagaaactgtgtttaaggcggcaaaagcctttacagatcagtatatttgaattcgctgggggtgcatatgttgacagtaccggaacatccttttaaccttatggcaaaagtgtatcgggaaatttttccgctcgttcatcaggaattgaacatgtggcgggaaaaatcagattccattaaaaataccgaactgcggcagcaggcggccgcaagtatccgcgataagtcgtttcattgtgaaggcggcggcattttagccctgctttcgggagaacagaaacaaaaatgcgtgcaatttatcatcgcgtatcagacaatcagtgattatctggacaatctgtgcgaccgcagcacctcgcttgatcccgaggacttccgcatgcttcatctctccatgcgtgacgcgctgacggtcggtgccgaggtgcggccgtactatcagtacagagacgagcaggatgacggcggttatcttcatgagctggtcagaacatgccagcgggtgctcgggtcaatagaacattacggtatcattaaaccttatttgcttgagctgtgtgattattattgcgaccttcaggttcataagcatgtcgttgagcatgaacgcgttccgaggcttaaaggctggtttgagcagtaccggtcacagcttccggaaatggagtggtttgagttctcggcctgcgccggatcgacgttaggcattttctgtctcgttgcttactcattccagcctgattttaacgaacataccgctgagaaaatccgcagcagttattttccgtacatacaagggctgcatatactgcttgattatttaattgaccaggaagaggatctgcttgaaggcgatctgaatttctgtacgtattatcagtctcatgaagaaatgatgcagagactgcagcattttattgaaaaagcggatgaacatttgcaaggcattccgcatgaaaattttcaccggctgatcaacagagggctgctcggcgtctatttatccgatgacaaagtcgccggccaaaaagaaatgggccgcctcgcgcgaaagctgatcagggctagcggaaaaacgtcatttttcttttatatcaacggaagagcctaccgcaaatttcagaagatggcttggacgaaaagttcgtaatgggtgaactgcgcctctcgtgtaaatcatgacggcgcagttttttatttatgacgtgaagtatgaaatgaaacattgtttgcgcctgcagaatatgatactttaattttatgaaaaaattaaagtatttagcggtcatagcattactttccatttccggaggctgctccgtcatccatgcttccgccggctatcatcctgtattgatagcgcacaggggctcttctgcgattgagccggaacatacagctttgtcttatgcgcgtgccattaaagacaaagcagattatattgagatagacttacggaagacgaaggacggccatctgattgcaattcacgataaaacggtagatcggacaacagatggtaaagggatgacagatgatctgtctttggctcagattaagaaactgaatgcgggaaaaggagaaaagattttaacattagaagaaatcatacagaaattcggacaaactgccaattactatattgagacaagagaaagcaacggcagcctggtgatggaaaagaaactgattgacatattacaaaaacataagctgatttccagccataaagcagtcattgagtcttttagcgggaagagcttaaagaaagttcgatctatggataaaaaagttcctcttgtccgattattaaaagataacgaggctgaggagataaatgataagcagctgcaaaccatcagaacgtatgctgatacagtcgggctcaacgccaaattggcaaatgaagcagtcgtgaagcgtattcatcacaataagatgaaagtgcacgtgttttttgataaggaagacgagcatacgctgacgcctattatgctgaaacaaaaagcagatggtgtctttacaaacaatcccgcttatacacgcggcgtgctgcaacaaaacagtaaataaaaagagacatgcgcattttacgctgtctctttttttaacggtttcttttttgccgcaaggtgcattgcgaatttgccgatcagcccgatgacaaaaaatgcagcaaaccaccagtaataggtttttgcgaactcaaatcctaaatgtcttgataaaatgatgacgaacatcacatagggaacacttgaaaatatgatgcgaagaatattcaaactgccgctcctcccagatgttacacttaaaagatgaacttttttccattatttcatagtaattgatttttcagaaaaagtaaacacaaaaagaatcggcccgcttatgtcaggccgattctttatttgccggcagatttcttttcaatcgctataataaacggcgggtcgtttcgctggttgagaaagccgtagctcagcacgcgcgctttttcctgatcaagattgctgcagtactccagtaatgcacttttttccgtcttgccttcaggatgcccgtggtacacaacgagaacgatcagcccgttctccttcagcagttcaaggagctgttcgatcgcggaaatggttgagtggccgtttgtcgtaatgcttttatcgccgccgggcagatagccgagattaaacacggcgcaagccacacgaccgtgcgcatcctcaggcagcgatgcctttatttgatcatggctcttatggtgaagcgtgacgcgcggactgaagtcggcaccgagccgctccttcgttttagcgagtgcgtccgcttgaatatcaaaggcatggacatgtcctgtttcaccgacaaggctggccaggaaatatgtatcatgtccgttgcccatcgtcgcgtcaaccgtgatatcaccttcctgtgcggcggacttcagcaattctttactgaaagggaggatgtgcatcaaggtcatagggcggtctcctccccgatctttctgaagagctttccttgatagcttccccgtgtttccagctctttttgaatggcgcccagtacttcccacttattgacgctccacatcggtccgaccattaattcgatcggcccgtctcccgtaatgcggtgaacgatcatttccgggggaatgatttcgagctgatcacatacaagacttacatattcttcttgagaaaggaactccagctttcctttttcatattgcttcaccatcggtgtgccttttaataagtgaagcaggtgaattttaatgccttggacatccaaatcagcgacggctttggccgtctccatcatcatgtccctgttttcaagcggaagcccgttaatgatatgggaacaaacgcggatgccgtgttttctcagtttattgacaccctcaacatagcagtcaaaatcatgggcgcggttgatcagaagggcggtccgctcatgcacggtctgcagcccgagttcaacccacaaataggtccgctcattcagttcggccaaatattccacgacatcgtccggcaggcagtccggacgggtcgcgatcgacatgccgacaacgccgtcaagcttgaggacggattcgaatttttctcgcagctcctctaccggagcatgcgtattcgtgaacgcttggaaatatgcgatatatttgccgtctttccacttttcgtgcatgcggtttttgatatcgtgaaattgcgtgagtaagtcatcggcccgattgccggcaaaatcgccggagcccgccgcgctgcagaatgtgcagcctccgtgtgcaaccgtgccgtcccgattcgggcagtcaaaaccgccgtcaagcgcgactttaaacactttatgcccgaaatgctcccgcagatgataatttaatgtatggtaccgtttttccgtatttgaataaggaaaagggttattctcgttcaatgttcaaaaagcctccctcacatcagatgcatcctaaaattgtagcatgaatgatggagcggaacaatgaaacaattatggaacggtcaggacgtaatatctacctggtttttctgttgttgttttaaacgttttggagaaatatcactgaacaatgcaaaaataattcctaaaataagaattacactgcctactttgaatgtattattaaaactgtcacttattttttcattatataaatttgaaatttttttctggatagccataacttccttcttttgaatattgaagcttttttgtactttttctttatacggatccggggttatagagagaatttcttcctcttttttgtttaattcagcaatacttttgcttcgatcgaaacctttactgtctgaatgctttaagtgagttattatctcgttctttgcatttttatcaaaaacctgattgctttccacaattttaatggcttcttttttcgcagtagctgtgtgatcatttatattcattgtaagcacagatgtaagtatggcaattcctagcgcttgtccaactgtccgcatcatattaagaatacctgaggcaattcctactttctcaggaggaataagccgtatccctgaactcattgctggtcctattacaagccctaaagctaagccggtcaaacataacagaataattactgacgttatagaactgtcgtatcgtatgtatccatataaatatgttgtgattgttaaaccgagcatacctagacccgaaagccaaatgcccccgagtttatcagatagctttccagaaagtacagaggtaaacatagatgatagagctaatgtagaaacaattaaccccgcttctaattcagtttttcccattaaattagtgaggagtaaagtaataataagggtaccgcttgttaatccaaggccctgcataaagagggtgaaagaactgaaactaaacgtacgtatcttcagcatggataagggaatcatcgggtttttaattttagattcaataaagaaaaacaaacagaataataatacagagattacaaaaagagagataattaatggtgatgaccagcctaagtcagatacttttgcaaaaccaaaggttaaacagaagagagctccggataaaataagaatccccatgtaatcaatttttttactcactgtttcatcataactctcagtaataaaaaatgctgctaaaaaaagagaaatcagacctaaaggaatatttatgaagaagatagcttgccaattaaaattttcagttaataatcctccaagtacaggtcctaatgtagctgctaatcctgagaaagcaccccagattccaatgatcattccttttttattttgaggtacgatagctaaagctataggcattgtaacaggtacaatgaaagcagcagataatccctgaatcactctaattgtgacaagcatttcaattgaagtgctcaaacatgcaataactgatgtcaaaataaaaagtgctaatccaaacataaaagctttttttcttccaaaatggtctgccagctttgatgcacctactaataaaaccgcaaaagctaaagtataacctgtagccacccatgctacttgagaaaggttactcgaaaaataattcagcatcttaggtaaggcgatatttactatagtggtgtccattactgaaatgaatgtacctaataataatgcagataacatgattatttttttgaaattcaatatacttacatctccttttagaaaactatctaattaaaactttgacgtatgtctaaaaacataataagaaaaaaaatcatttgtgtcaatattattcataatatgtttattagacccaatatattataaaataacaaatgtattaagataaccattactttaaatctattaaaattccaaattaatactttacaaatagacaataattccttattattatttaaaagttggtttttcatggttttttttgaaaaaggaggagctaatgacccatccaattaaacttttttgcattccgcatgctggaggattgtcaagtatttatagtgaatggagtaactcagttggaccagaaattgaactaatacctgttgaactagcaggaagaggctctagattttctgaaaatccctacaaaacaataaatcaggctatagatgatattacagaattaatattaagaaaatgtgataataagtgctatgcgatttacggccatagtatgggtgcatatatatcgtatgaagtaatacttaaattaatgaaggttacagataatcttcctcagcatttatttgtatctggaaaaggcgcaccttatttaactaaggaaacatttataagcggtcttcctgataaacaagttattcaatggttaaacaaattagggggaattcccaaggaacttatcgagaattacgaactaatgaaactatttcttccagtaataaggaatgattataaactaatagaaagttacaaccacaacatcaaaaaaaaattatcaaatgttacgttaactgttttaacgggcaagtttgacgaatcaataactataggagaagttgaagggtggaaagaatattcagcaaaggaggttgatgtataccagattagcggagggcatttttttattaatgaatccgttacagaagttatatcaattattaaagataaattattggtttaagtttagtatggaggtttttaacgtgaaaaaatacttttgggctcctcatgttcactggagaaatgaaaataaccatattattattaatgattttcaatttagagggaaagtagttgaactttttcctgatatttattttcattttcaaaaaggcatttctttaagcgaaatatatgttatttttaaagactttaatccaaagattttaaaaatgtttctaaaagatttaatacgtaatagagttttagtttgcaatgtaagcacaccgacagagcttttcgaaacgcaaaacaaatttgtttatcaagaatatgacgatgagttttttttatacaaagaaaatatagaatcttataagaagaaacaattaactaggtttatgtcaaagaatactcttcaatcaattgatttggaggaatgctcagatttgccctctttagttcaaaatagaaaaagtactaggaattttgatactagtaaaatgatgaatttttctaagtttaatcggttgttaaatgtctttaaacagtctccaattcaagagggtattaaatatttctacccaagtgcaggaggactgtatcctgtcaacatatatttgtatattaaagatgggagagtcgaaaatcttgaggaagggatatatttttataatcctcacagccactctatcaatttacttaatagagtaaaactggctgaaaaaaaatatcattattttataaaccacagtgcatttaatacttcgaatttctctatctttttcacccttgattgtgatgtaatcatgcccaaatataagggtgcggggtattactatggtattcttgaatgtggtgttatgtcagctacattggctaatatagcagaatattttgatgttggatcgtgctccataggagaaatagacttcgataaaattaaagatgaatttaatttgaatagcaatgaaatctatttacattcggtagaggtaggactaaagaataaggaggtaaatcattgattaataacacgctagtaacgagtaataaatttaaagagatttctaactttataataaaaaaaattcgtgaattaagtaaagatgattcagttgatttaagaactaatatttttgattatcaaatatcttctattaatatattaaaattacttggagccattgaagatacatataatataaatattgaattttatgattatattgacaacccagatgtactgtcattttgtcaagttgtttatgaaaagtttcagttattagataataaaaaagagtataatatattacatttattaagcgatgaagaaaatgcctataaagaatttgatcttacaaatgttcaagttgcttatttatctggaagagacaagcaatttgaactggggggaacttccacccatgcttttgtagaatttgaggctgaactagatattgaaaaattcaataaaagtgtacaagctgtgatagagcgtcaacacatgctacgtgcagtttttttatcaaatggtaagcaaaaaatacttgaacacgtaccgaattataaattagctattcaagatgtgagttatcttaaaaaatcagaccaagaagacaaaatattagaagcaagaaaagtaactaacgaacgaatcttcgatccataccaatggccattgtttgaatttaaagctttaaaaatcagtgataaactatatagaatattctttgatatcgatatgttaatagcagatggagctagtatccagcttttatttaaagagatatctgaattgtacaatggaaagattcaagagcctttagaagtatcctatagagattatatgttagcttataacaaattaaagggaaatcataaatatcaggatgacaaggaatattggttaaataaacttaaaagttttccttcaacaccagctctgccagtaaaagtagatttagcatgtataaaaaaacctacttttaaaagaaagaaaaaaattattgagaaaagaaattggaatcaatttgtgaatttatgctctcggaagaatattaggcctagtatactacttttgtctatttattcaaaagtgttgtctaaatggagtaatcagcaaaatattgcgttaaacactacattatttaaaagaagacctttgcataagcagattaataacgttataggcgattttacagaaattatgatatttgatgtatgcttcaataatttaaatcatttttgggaagaagtaaaaaatattcaggataacttctttaaatgcttatcacataatgattttgatggaatagagtttaccagagaatactgtgaatttaatgatatagatagaaggaaagctgtttttccgattgtttttacaagtatgttatttgaaaatgaattaaactatttagattctctaggagtttttatagagagtatcagccagacatcacaagtttatctggatcatcaagtgatagagctcaatgatggagtcatgcttagttgggactatgtttcagaggcttttgaaaatgatgtaattgagtcaatgtttgaggaatatacccacattattgaccaattaacgtccggtgagatgatgtcttctgaagatacagcactggaacaagcaattactgattataatcaaactgagaaggccatcaagccggatactttatatcacttgtttgcgagacaaacaataaaaacacctgagaatattgcgattgagtgtcaaggaagagcagttacctatcaagagttacaagtcatgtccaaccgcatatctagttttttggaagagaagggaattcagccaaatgagtatgttggggttattgttgatcgtgagatcgagacaatcgccagtatcctcgcagtgttaaaaattggagctgcctatatcccaattaatccggaatttccaaaagaaaggcaatcatatattctgaaagatggtgattgtaaagttgtattaacagctgaactggcaaaaactattgtgtcaagctataaagagtctaaaagagaaagtgtggcagtgccggaacaaatagcttatgcgatatacacttcaggaagtacgggaaaacctaaaggtgtaattataaagaatgaggctgtaactaatactatattagacatcaatgaaaaatacagtgtgaatgaaacagaccggtttatcggattatcatctatgtcctttgatttatcaatatatgatatttttggtgctttttctgcaggagcaacattagtaatgatcgaagatcagagagatattaaaaagattcatgacatcgtaaaagaggaaaaaattacagtctggaactccgttcccatgatcatggaaatgttagtaaactatatggatgaaacagaaaacaaatctaacgctggagttattaactatgacgagcttcctgaattaagactggtattattaagcggggattggatacctgttcatcttcctgagaggattaaggatcacttcgttgaaagtgaagtcataagcttaggcggggctactgaagcgtctatttggtcgatttattatccaattaaaacagtcaaggctgaatggaccagcattccttacggttatccattatcaaatcaaacttactatgttttaaactatgaaaatgatccttgtccaatcggagtgaaaggtgaactttacatagggggaaaaggtgtagcagacggctatttaaatgataaagaaaaaactgaagcgtcatttattgatcacccagatttcggaagaatttatcgtacgggggatatgggggtcttgacgcaagagggttatattgagtttttgggacggaaagatcatcagattaaagttcgtggatatcgcgtggagttaggtgaaatagaaagtgtaatattagagcaccgacaggtgagaaatgcggtagtcattaatcaaaaggatgccagaaatcaagatgtgttatatgcgtacgtaacggggcaccaatccttaccgccaactgatctgaaagagtttttaagcctgaaagtgccggaatatatgatacctagctatatcgtacagattgaagaggttcctttaacaagtaacggaaaagttgatcgtaaaaaactactggctctagacgttacagatcaagcatcgattggaaggaaaatcaaagagcctcgaacagaaattgagagagatttagttggtatctggaaaagcgttctgaaaacaaatgaaatcagcatagatgacaacttttttgaattaggcggcaattccatattgatcattaatttaattactgctattgaggatcgtttatttattaaattagattttaaaaattttatatccaacagtaccattgagaaactagcaaaagttatcagtgtctctgaaagaaaaagtaaaacaaatagtaatgtgatggaaattcaagctgatatcaagcataaaaatacggaattcgatttaactaacgttcaaatggcttatctaatgggaagagataaacaatttgaacttggtggcacctcaacgcatgcttatttagaaattgagactgagctgaatattgaaaaactcaacaaaagtttacaaaaagtaatagatcatcaagacatgctgcgcgcggtcattcttccgaatggaaggcaaaagattcttcaacaagtccctcagtatgaaatatctgtacaggatattagtcaattaagtgatatagaacaagagaagaaaattgcagaagaaagagacagaacatcacatcatatctttaatccaaatgagtggcctttatttgaattcaaagccttgaaaattcaaggggataaacatagattatttttcgacatcgatatgttaatagctgatggagccagcatccagcttttatttaaacagatatctgaattgtataatggaaaagatgaaatggtaccattggaaataagctatagagattatatgttagcataccaaaaagtcaagaccactcaaaaatatgaaaatgataaagcctattggttaagtcagctcgaagattttccaaaagcacctgcggtgccattaaaagaaagattagatgcaataagcaagccaactttcaaaagaaaatctaaaataattgacaagcttctatgggaaacactttgtaaaaaagctgcaagctataatattacacctgcaataatattatttacagcttacgcaaaagtgttgtcgaagtggagtaaccaacaaaacttagcggtaaatacaacagtatttaatagacagcctctccataaacaagttaatgatataataggtgattttacatcgctgattatgttaaaagcgagttttgagaaaaaaatgaacttttgggaggaggcaaaaaaggttcaggttactttcatggaagcgcttgaacatagagactatgatggagttgaatttataagagaatatgctagatataataatttaaagcacaaaagtgcgacaatgccagtagtgttcaccagtatgttatttggaaacatgtttaatcttaataataatgatctattgaatattggtgagttaaaaatggcagtcagccagacatcacaagtttatctggatcatcaagtgatagagctcaatgatggagtcatgcttagttgggactatgtttcagaggcttttgaaaatgatgtaattgagtcaatgtttgaggagtatacccacattattgaccaattaacgtccggtgagatgatgtcttctgaagatacagcactggaacaagcaattactgattataatcaaactgagaaggccatcaagccggatactttatatcacttgtttgcgagacaaacaataaaaacacctgagaatattgcgattgagtgtcaaggaagagcagttacctatcaagagttacaagttatgtccaaccgcatatctagtttattggaagagaagggaattcagccaaatgagtatgttggggttattgttgatcgtgagatcgagacaatcgccagtatcctcgcagtgttaaaaattggagctgcttatatcccaattaatccggaatttccaaaagaaagacaatcatatattgtgaaagatggtaattgtaaagttgtattaacagctgaactggtaaaaactattgtgtcaagctataaagagtctaaaagagaaagtgtggcagtgccggaacaaatagcttatgcgatatacacttcaggaagtacgggaaaacctaaaggtgtaattataaagaatgaggctgtaattaatactatattagacatcaatgaaaaatacagtgtgaatgaaacagaccggtttatcggattatcatctatgtcctttgatttatcaatatatgatatttttggtgctttttctgcaggagcaacattagtaatgatcgaagatcagagagatattaaaaagattcatgacatcgtaaaagaggaaaaaattacagtctggaactccgttcccatgatcatggaaatgttagtaaactatatggatgaaacagaaaacaaatctaacgctggagttattaactatgacgagcttcctgaattaagactggtattattaagcggggattggatacctgttcatcttcctgagaggattaaggatcacttcgttgaaagtgaagtcataagcttaggcggggctactgaagcgtctatttggtcgatttattatccaattaaaacagtcaaggctgaatggaccagcattccttacggttatccattatcaaatcaaacttactatgttttaaactatgaaaatgacccttgtccaatcggagtgaaaggtgaacttttcatagggggaaaaggtgtagcagaaggctatttaaatgataaagaaaaaactgaagcgtcatttattgatcacccagatttcggaagaatttatcgtacgggggatatgggggtcttgacgcaagagggttatattgagtttttgggacggaaagatcatcagattaaagttcgtggatatcgcgtggagttaggtgaaatagaaagtgtaatattagagcaccgacaggtgagaaatgcggtagtcattaatcaaaaggatgccagaaatcaagatgtgttatatgcgtacgtagcggggcaccaatccttaccgccaactgatctgaaagagtttttaagcctgaaagtgccggaatatatgatacctagctatatcgtacagattgaagaggttcctttaacaagtaacggaaaagttgatcgtaaaaaactactggctctagacgttacagatcaagcatcgattggaaggaaaatcaaagagcctcgaacagaaattgagagagatttagttggtatctggaaaagcgttctgaaaacaaatgaaatcagcatagatgacaacttttttgaattaggcggcaattccatattgatcattaatttaattactgctattgaggatcgtttatttattaaattagattttaaaaattttatatccaacagtaccattgagaaactagcaaaagttatcagtgtctctgaaagaaaaagtaaaacaaatagtaatgtgatggaaattcaagctgatatcaagcataaaaatacggaattcgatttaactaacgttcaaatggcttatctaatgggaagagataaacaatttgaacttggtggcacctcaacgcatgcttatttagaaattgagactgagctgaatattgaaaaactcaacaaaagtttacaaaaagtaatagatcatcaagacatgctgcgcgcggtcattcttccgaatggaaggcaaaagattcttcaacaagtccctcagtatgaaatatctgtacaggatattagtcaattaagtgatatagaacaagagaagaaaattgcagaagaaagagacagaacatcacatcatatctttaatccaaatgagtggcctttatttgaattcaaagccttgaaaattcaaggggataaacatagattatttttcgacatcgatatgttaatagctgatggagccagcatccagcttttatttaaacagatatctgaattgtataatggaaaagatgaaatggtaccattggaaataagctatagagattatatgttagcataccaaaaagtcaagaccactcaaaaatatgaaaatgataaagcctattggttaagtcagctcgaagattttccaaaagcacctgcggtgccattaaaagaaagattagatgcaataagcaagccaactttcaaaagaaaatctaaaataattgacaagcttctatgggaaacactttgtaaaaaagctgcaagctataatattacacctgcaataatattatttacagcttacgcaaaagtgttgtcgaagtggagtaaccaacaaaacttagcggtaaatacaacagtatttaatagacagcctctccataaacaagttaatgatataataggtgattttacatcgctgattatgttaaaagcgagttttgagaaaaaaatgaacttttgggaggaggcaaaaaaggttcaggttactttcatggaagcgcttgaacatagagactatgatggagttgaatttataagagaatatgctagatataataatttaaagcacaaaagtgcgacaatgccagtagtgttcaccagtatgttatttggaaacatgtttaatcttaataataatgatctattgaatattggtgagttaaaaatggcagtcagccagacatcacaagtttatctggatcatcaagtgatagagctcaatgatggagtcatgcttagttgggactatgtttcagaggcttttgaaaatgatgtaattgagtcaatgtttgaggagtatacccacattattgaccaattaacgtccggtgagatgatgtcttctgaagatacagcactggaacaagcaattactgattataatcaaactgagaaggccatcaagccggatactttatatcacttgtttgcgagacaaacaataaaaacacctgagaatattgcgattgagtgtcaaggaagagcagttacctatcaagagttacaagttatgtccaaccgcatatctagtttattggaagagaagggaattcagccaaatgagtatgttggggttattgttgatcgtgagatcgagacaatcgccagtatcctcgcagtgttaaaaattggagctgcttatatcccaattaatccggaatttccaaaagaaagacaatcatatattgtgaaagatggtaattgtaaagttgtattaacagctgaactggtaaaaactattgtgtcaagctataaagagtctaaaagagaaagtgtggcagtgccggaacaaatagcttatgcgatatacacttcaggaagtacgggaaaacctaaaggtgtaattataaagaatgaggctgtaattaatactatattagacatcaatgaaaaatacagtgtgaatgaaacagaccggtttatcggattatcatctatgtcctttgatttatcaatatatgatatttttggtgctttttctgcaggagcaacattagtaatgatcgaagatcagagagatattaaaaagattcatgacatcgtaaaagaggaaaaaattacagtctggaactccgttcccatgatcatggaaatgttagtaaactatatggatgaaacagaaaacaaatctaacgctggagttattaactatgacgagcttcctgaattaagactggtattattaagcggggattggatacctgttcatcttcctgagaggattaaggatcacttcgttgaaagtgaagtcataagcttaggcggggctactgaagcgtctatttggtcgatttattatccaattaaaacagtcaaggctgaatggaccagcattccttacggttatccattatcaaatcaaacttactatgttttaaactatgaaaatgatccttgtccaatcggagtgaaaggtgaactttacatagggggaaaaggtgtagcagaaggctatttaaatgataaagaaaaaactgaagcgtcatttattgatcacccagatttcggaagaatttatcgtacgggggatatgggggtcttgacgcaagagggttatattgagtttttgggacggaaagatcatcagattaaagttcgtggatatcgcgtggagttaggtgaaatagaaagtgtaatattagagcaccgacaggtgagaaatgcggtagtcattaatcaaaaggatgccagaaatcaagatgtgttatatgcgtacgtagcggggcaccaatccttaccgccaactgatctgaaagagtttttaagcctgaaagtgccggaatatatgatacctagctatatcgtacagattgaagaggttcctttaacaagtaacggaaaagttgatcgtaaaaaactactggctctagacgttacagatcaagcatcgattggaaggaaaatcaaagagcctcgaacagaaattgagagagatttagttggtatctggaaaagcgttctgaaaacaaatgaaatcagcatagatgacaacttttttgaattaggcggtaattcaatttcactttcaaatatatacactaaaatagaaaaaaaatattcagatttgaatatagttgatttattcaagtatcaaaaaattagtgaattatcacattttattagtgttatgaaagaggagaataagaatttaaaattaaaatcagtaaaattgcctccaaaaattcttgctaatagaaaagataataaaaatgaaaagacaataattttagaaaaacagttaaaaattaagtttaataacttagaagtaagtaataaagtaataaatacatttttatatttatttagcaactttatagaaaacgatgaatattatgtatcccttttaaaatcaagctatatagatttggaaaaaataaatatagaagagtatagtgatttaaccgagtttataaaaaacatagaggaaaataagataaaaagaaagacagtatccaaaataaatttgcgtagcaacctgggtttagagagagataatgctcatattaatgttttaataatagataaacaaaaagtcgaaaataatattagcgaatcttatgaatttatatttagttatttagttaatgataacaatataaatctcgaattaatatttaaaaataataagttgcgggaaatctcagtagaaaagttttttaatacttatataaatattatttctgatttaatataaaagtagaaagagcacctttttcaggtgctctaaaaaggtgagtgatgtttttatgtttaatgtttttgaacaactagataaaaacgaaattaagttcactaaaaaagaaatagaaaccaaagtcgctataattggaataagctcgagattacctaaatcaaataactttagagatttttggggtaatttggttaatggagttgattgtattggagaaatagatagccagagaaaaaaggattgcgattatttttttgagaataaaggtatagatacgaaaaaaataaactatcagcaaatggcttttgtaaacgatgtggataaatttgattacaaatattttaatattccttatcaagaagcatctttgatggaccctcgtcaaagattatttttagagtcaagtattcatgcattattggatgcaggatacccagaaaaaaaagttaacggaagtaatattggtgtatacgttggtagcagtaatagtgattcaatatataattatgataaggttatatatgattcatctattcgaaatcctgtaagtattgttaataatcttccttcaatgattgctagtcgggtttcttattatttagatttaaaaggacctagtatgactctagatacttcttgttcctcctctcttgtagcagttcacgaagcatgtaaagctataattcataatgaatgtgagatggctattgcagggggatgtaacttaaatcttattcctcttcagcatgaagtaaggctcggcattgaatcgagtacttttagaacgagggcttatgacaatgactcagatggaacaggatttggagaaggtattattacatttattttaaaacctttattcagtgctttaagagataatgataacatttattctgtgatagaaggaagtagtgtaagtaatcaagggttttcttttggggttgctactccaagcattgaaggacaggaaaaccttatttcggaaaatattagcaagtccaatatagatatcaatgacatttcgtttatagaagggcatggaacaggaactgcaattggagatgtaatagagatagaagcaatcaatcgtgctttctccgaaattaacaaaaaaaattatttgcctatggggtctgtaaaaaataatataggtcatttattaagtgcatccggagctgctggattattaaaaagcgtgcttgcattaaaaaatcaaatgtttcccccaacgataaattataatactcctaataaaaatatagattttagtaactcacctgtgtttattaatactgagaaagtagagttacataaaaaagaattgctgttaggatgtataagttcttttggtatgagcggaactaattgccatatgattatttctaattacgacaaaaaaagaactattccaaatgaggattgtttagagcctcaaatattcacattttctgcaaacgatttggatactttaacttttctattaagtgatttatataattttcttcttgaagagaatctgatgctactaagtgatattggatatacattgaattgcagaagagatcatttagcaaatagagtggctataatagcatcatgtaaggaagatttattagaaaaattaaaagaagcattaaataagattcaacaaggaaataaaattattaaagatagtgaaatttattttaacgttaatgatataacctctaatgtaaaagaattgtctttaggagatgagtctcaagacgatttaaggcaaatttgcagaaggtatattatgggcggtgaaataagttgggacatgtattataaagaatataatcaagttgtttctttgcctgttttcacctttaagaaaactcggtgctggtatagtgaagaaaaaatagactttgtcttaaatgacgatgttattttaaatgaaaaagaaaaaattgtagttgaaacatgggcaaaactatttggcctaaataaaatagacttttctcaagatatttaccaagtaggtggagattccttgagcttggtaagtatgtatcatgaaatagagtcgaaaatacccaatatttcattagaagtgtttatagaaaaagaaacattaaatgaaattctagattacgttaatgaagcatcacaaaaaaataatgaaacagatgaattaatttttgaaaagaataattgtaaagtttataaattctcgaatggaataaataattcaaacacgtatttaatttgtaatcgtcataagagtatccttattgattctggagttagtttagaatatttaacagagttctgtgaaagattgaaattgaatcgaatagattatattgttcttacacatgctcactttgatcatacttattctgcaaatgaaataaaagaaaaattcaattgtaatttcataattcatgaaagagaaataaattttgcgagagatatcataaataatggacttgcccttcttgggaaaagttttacgtttgaaagcgatgatatcctaattaaagataaatatacagttttaaacattggagatattagcctcaagataattctcagtccgggtcatacaacaggtagcgtatgcgtgctttatgacaattttttatttacaggtgatactatttttaaagataaaaaagcaaaacccgataaaaaaacaggaaatgaagattatttaaagaaatccatttcttatttaattaataatactgaagataatactataatatgccctggtcatgaagatattacaacaatttcatttgtgaaaaaaagaatttatgatttttgattttattttatgaggtgtttagatgtgaagttggtgattagtgacagtgtttcggatttttttgataagatttcttctctgcttttcttaaaacacgaaggattcttcaaagattatagcattaaaatgggtataaaattagataatgaatattttgtattactagatgatcttaaaagaataaaagagttagatagtgagtttttaaatttttattttggcagcttttgcgactacaaagatgttaggaatgcaaatattttttgtttagccacaaccttttttaaaataccacaaatttatacgaaagatttttttgaaattattgattatttgtctgcagttacagaagaagagataagaaaaaatattttagagtctctaatttatttacaaggagatcttaaaactgaaacatctacccaacagtatttaaatgatagggaaagtttatttgagctacttaataatctaaatatcaagcccgaatacaagtggatcatatttaaggtaatgaaatctcctaaaacttatgtagatcaattttgcaataaattaatgttggtgaatggttatcttaacgaggcgatttataatttaattaaatttagagatgagtggatgaatcaattaaaaaacataaatatggattttccaaaaaagataatcagtacgttaaaaggtaaggaatacttatcttgtaattatattaatatatatccaacacttttaccttacactgcaactattacgaaaagtgaagataacatttatgttggactggggtataaagttgatgaaatttttgaaaatacattggagaaagcagagattaatcacatcattgattttttgaagcttttatcggataaaagtaagttcaagatattaatcttacttagtcataaaaaaatgtatgctaatgagattgctgaacagctaaatttaaccaacgcaacgatttcacaccatatgagaattttgacattgcaaggtttagttgagagtgcgagaaatcaaaataaaacatactattatcttaattcttctaaatttcattctcttctaaatggattattagggaaatttaagtctgctttaattttagagaaagaggagtaaaattaagtgtataaaacagtttatgattttatagttgatgctgaaaatcgagatgataaaggaattacatttataaatggatccgataatgaagtatatatttcttatgctcaattatttgaaaaatccagaaaagtattaggtgttttacaaaaaaagggtttaagaaagaaagatgaactaattatacaaattgaggataatgaacaatttattaaagttttttgggcgtgcatattaggtggaatcatacctattcctttaagtgtggggtataatgaagagcataaacaaaaaatacttcgtatatggagtattcttaataatccttattgtatttctgatcaaagaacattacattcacttgagaaagttgcggatgcagaaacttattcatcaattgtaaaacaatcaatttatttagatgaaattaagaattctaatgaagtgggtgaattaatttcccctaaaccagaagaaattgcttttattcaattctcttctggtacaactggagatcctaaaggtgtaatattaacacataaaaatcttattaccaatatatcagcattaaatgaggcttgggagacatcgaaatccgattcctcactaagctggatgcctttaactcatgatatgggcctcattgctattcacttagcatcaacgtataaaaaaattcaacaatatataattccaacctccgtttttatccgaagaccgactttgtggttattgaaaacacatcaacaccgtgttacacaattatactcccctaactttggatataagtttttgttggataactataaaaaaaatcaaatctataactgggatttaacttgtgttagattattagctaatggagcagaaccaatttctacttctttgtgccagagatttttagaagaaatgaaacaattcggattaaaatatgaaaccttaaatactgtatatggtttagctgaggctacagttgctgttagtgtcccaaaattaggaaacccttttgttcctgtaacccttaatagggaagctttagaagtaggtcaaaaaattcaaaaaactgttgaagaaaaaaagggattaacttttgttgaagttggcccggctgtacgtcattgttctttccgtatatgtgattctaataattacgttctggatgatgattttataggtcatgtgcaaataaagggggaaaacgtaacgtctgggtattacaataatgaatctgctaccaaagacgctataactgcagatggatggttaaatacaggagaccttgggtttatacataataatagtttggttattaccggaagaacaaaggatatcattataaagaatggccaaaattattattcacatgatatagagagagtagcagagaatgtaaaggatattgaattaggtaatgttgtggcatgcggggtcccgaatgaaacaaaggcggaagaagatcttgtgatatttgtaaaatgtaagcaaagttacgatattacaacagcagagaaggaattgaaaagagaattaacaaaacaattgggtttgaatgtacatcaagttatacctgttaggaaaattttcaaaactacaagcggtaaagtgcaacgttctaaaatgaaggatttttataaagagttaattctgtcttgattaagttttacatttaatcgtattttataccatctctgtcttgtgtatgaattacctgatatttcttgtgagaatttatttggaataagaaatactattgatatgacattatcaataggaggactgtttaatggcaacaagacaatcagtagatgaacatctccaaagaagcgaacaggcgtatgaatttgcgaatgagcaatttatgaccgcttcaaaacaagagcattataatgataatgagtacagtgaagcgcaaatgatgcttgaaaacgcggtgaatgaattaaacaagctgtcattatctgcgaatgatcagcaaagagagcagctttatcgaatgagattgcagctgcagaccttgcaaaacaatatgattttgcagcgtaattttgattactgaccgcgccgtttcaaatggttcagcaaacctgccggaatcccggcgggtttttttgtatttttttaaaaaaagaattgacaatagggcggagtgtgtttattgtattacgtgtactacttgatgtaatacacataaaacactcaaaaaatgaaatcgacatataaatgttaagcatagggaaggggaactttcatgaaaaacaaaagatccgtaaaacaagatgtgcctcttattatcgccgcctcggttttggcaagcagtctgtttgtcgttcttgtcatcatcggttttcaatggcagaacatttaaagaaagagagcagctcgtaaaagaaagaagggaagtaaatgattcaaatcgatccgagaagctcaactccgatttatgagcagattatacagcaactgaaagagctttgtttaaaagggatcatgaagccgggggataaacttccttctgtcagggaattggcaacgatcattatcgccaatccgaacacagtcagcaaagcgtacaaggagctcgaacgcgatggtgtcattgaaacgctgaggggaagaggaacgtatatatcggagaatgcaaaaacgacattggttgaagggaagatgacgatgataaaagagcaattgaaacagctcatcatcgatgcccattacgcgggagttgagctggagaagctgcaggaatggataaaggaaatcagcgctgatgtgaaaggaggcaaggatcatgattgaattgcggaatctctcaaaaacgatagacggtaaagaagtgctcaaggatatttcgctcaccatcggaaaaggggaaattttcgggctgctcgggcgaaacggatcagggaaaacaacactgctccggctcattcagcagattctgctgccggatcaagggacggttttatttaatcaggtggaaataaagcggcatccgaaagtaaaacagaacatcatttatatgcctgttgaaaatcctttttatgacaagtatacatataaacagcttgttgcaattgtaagcagaatctatccgaattttgatgtgacttacgccaatgagctgatgaacaggtacggcattccggaaacgaagaaataccgtgaattatcgacaggcctgaaaaaacagcttgcgctcgtccttgcctttgcttcacgcccggctcttatccttttggatgaaccgacggacggaattgacgccgtaacgcgtcatgacgtgctgcagcttatggtggatgaagtggctgaacgggaaacgagcattctgattacctcacaccgtttagaagatattgagcgaatgtgcaaccggatcgggtttttggaaggaaatcagctgacgaatgtgatggacttggatgatatgaaggaagagtacatgaaaatccaaatggcatttgaagaggacgtcgccttgaagatcagagaacaaaacataccgattctcgaccatgccggtgtgttttatacggtgctgattcaaaagaacgatgagaagaaaaagaactttctgcaagagctgcggccgaaagtatggaatgaacttcctgtgaacttagaagaggtcttcatcgcgaagtttggagggaaccggagatggtagacaggggattgctgtacagggaatgggtgcagaatcgaactgttcttgtgatggtcggcatttttttagcggcggtcaatccatttgaagtgttaaatacctatctggtttatcaaggctgtctggacacccacggagcatattgtaagttttatgtgaattctttggatagcggaatgctgaacttgaactgggcgcccgctgtcatcttagcggtttgcttattcggactggaacgtacgaaaggaacgattgatgcgcttttcagtctgccttattcccgcgctcaggtgtttcacactaaattttggctcggggcggcggtcattaccggcgctcaggtgatcggctacgggctggctgagctgctcattcttctgttaaagcctgagcgcgtatatttcttccaccattacagcgtcggagagattattgtgagtattttggcttttgcattggtcgcgagtgcaggctgcttaacgggcaatacgttcgcccagctgttaacggcgtttactgtgtcgatagcgccttacctgattattacgctgccgctgtccaatgtagaagtcatcttcggagtcagcatgtatgagctgatgccgtcagtcgaggcttatctcaaagtaaacaatctttttcaatacttgattccgatcatgtacatagatacagattgggtatctgccagcaagtatatattaatcatcccggcagtgatgagcattgtattttatgccatcgggtacttttgctatgtcagacagccggcggaacggaacggccgtttttttctctggagacagcttgaccggcccattcagattgtggtgattataatcgccgttctcggttttggcctggcggggtactcgacgggacagacgatgacagggtatgtggccgggatgctggtcggaggagcgatcggatttttggtcagttattttgccatatataaaaaaacgaagcatgtgtaagagaggaggaccggaatgataccgcggggattgttgtacacagaatggaagaaaaatcagtggttgtttttatgcagcggcattcttttaatggcggcaaacccttttttggtttataacaactactcaacatatcaagaatgtatgaataaccaagctcttcaagattgtgaattcgttgtcaattatacgaatgggtcgcctctttccttcagctggattgtaagtgtcatcattgccgtcttcttattaggcttggaacggacaaagggaacgatggatgctttgttaagcatgccttacagcagaggccaaatctttcagacgaaattctggctcggcggggcagtcattgttgttcctcaggtgataggctatggagcggcgtcattgctgatatctttgctgaaaccgagccatacgtacgattttgatcatttttcaatcggaatgattgtcatcagttttatggcttacgccttgttaatggcatccggcgcattaacgggacagatattcgcccagctgttaacggcgtttaccgtcacggtactgccctttttactcatcggtctgccggccgcgaatttggaggttgttttcgattttagtgtgggagatcaattttcttttatcagcagttatatcgaatcccgtctttttatatttgtaacccctattggatatgtgtttaacgactggatcagagaaagggatttggttttaatcattccgattgtgatgagccttgtcttttatctgatcggttatgtcagctttctgaaacacccgaatgaacggaacggcagattctttctttggagaaaattggaccgtccggtgcaaatcttggtgattgcctttgctgttatgggtttcggcgttttcggatatggggtcacagacacgatgttcggctatttagccggcattatcttcggtgcggttatcgggtttttcatcagttattttacggtttacaggaagtcaaagcatatgtagatctgtttgaaaatgaacagtttggaggaaggcaaggtgccgattagcggtttgctttataaagaatggaagcagcggcagacgctgctgctccttacagcggggttcttagctattttaggccctttggcaattataaatgagtattttcactataaggattgtttgagtgcgcttcatcaatattcaggttcagtttgtacgttcagcattgattacagcaatcggaatttgattgggcttcatttcattcctccggttatgatggggctttttctgataagaggaggccgggctgaaaggatgtttacactgagtcttccgtattcaagaagccggatatttcatacgaagtttttcttgggagcagccgtgttagccggctcgcaatttgtttcttacggagtatctgacatattgtttctagcgcttaaacctgacgctgtccatcattttcaatcattcagcgcagggatgctggtcatcagcttgatgatttatgcattagtgacagctgccggcacgataacgggcaatttagcggcgcagctgatcacagcgttcacggtttccgtctttccgatcgtggttatgacgatttacctgttaaacgctgagttcctttttggcaggcaggctgtgccggatattgatttcccttggagcggatttctgatctatttcatgcctgccgcttacttccatacatcatggatgtattacatgaaacacgcattgttaatctccgcattaatgggattttgtttctatctattcggctatgtgaatttcctgaaaatgccgagtgaacgaagcggacattttatcctaagcaaacacattgaacgcaccattcaagtgctcgtcatggtgctcagtatgctgggaagtgcgggggtatgcggatatgcttataacggttcgtataccggttacatattcggcatgcttatcggcgcggttatcgggtttttcatcagttattacttcatctataaaaaaacgaaacagatataagggggagtggtgtacgtgatagaagtacagcatattgatcattcatttaaaatcggcaggaaaggcagagagagtgaggttccggtattgaaggatgtctctttgaccgttgaaaaaggggaaattgcctgtatcgtcggtcggagcggttccggaaaatcaacgcttctgaatttaatatccggatacatagcgccgacgaagggccgtatcgtcattaacggcactgatgtgacgggcttcagtgaaaaagagtgggcgcagttccgcctcgggcatttcggctttatttttcaaagttttcagctcattccgagtctgacaacctatgaaaatgttgaaatgccgcttgccttaaaaggcgtcaaaccgtctgaacgcaagcagaaagtcgcggacatgctgaaacgggtcggacttgagaatcatgcgaatcattatccgaatgagctgtcaggcggccagcagcagcgtgtcagtatcgcaagagccctgattttaaatccgtcaattattttagctgatgagccgacgggaagccttgattcagaaacggaacttgaggtgcttgcattaattcagcagctgaaccgggagcgcgggattacatttgtcatcattacgcatgacgatgaagtcgcttcgatcgcgcattcaaaattccagctgcatgacggtgtattaaaagggggcgttactgttgagatttaaggatcagattcactttatcagaagaaatatgaagaaaaaccggctgcgtgttttcatgacggtgctggcgacgacaatggcgtgcgcgtttttagtggtgctggcttccgtcggattcggcatccaaaaaacgattacagacattacgatgagccagcagattgttacggaaatcaatgtgctcggccaagagaacggaaaagccgtgaagaaatcagacttggaaaagtataaaaatgtcaagtctgtcgttgaaagaacacaagtgtatgaaccgaacaaagcgtcattgggaaaccgaacaaatgaagattcagccattgtgctgacaaacatgaacgatgaagtcaaagccaatatggagcttgatcagggaagagtcgcccgtacagagaatgaaatcgtggtcggctatgattttgcgaagaacctattgacgaaaaaagaggctgacgcttacgacaaagagttaaatgatcaccaaggcgacatgtcggaggtgaaaaaaccaaaaggctatacgaaagacctgcttaataaaacgatacagctgagcatctccaaaacaaacaaagacggagacgttgagaaaacgaaaacgtacgactttaaagtagtcggaattacaaaaaaaccgtcccaagattggatggaggatacaaatatttttgtgagtgatcaattcaagaaagacttctcaacattcttggatctgaagaatggaaatgcggaaaaaagcatcaatgtgtatgcggacaaattcgatcatgtcgatcagcttacccatgacctcacgaatgacggcttttatgtcagatctgtcactaccgagctgaagggcgtcaacacctttttccttgtctttaaaatcggcctgatctttgtcggctttatcgccgtcgtgatttctgccatcggtattttcaatacgatgacgatggcggtgacggaacgaacgcaggaaatcgggattatgaaagcaattggcgcaagcccgtccatcatccgcagaatgttcctgatggaaagcgcctatatcgggatattaggttctgtcatcgggattatcatttcttacggagtgagttttgccgtcaatctggctgtgccggttattttgaaagcggtagggggaaacaccggagccgaagatcttcattataccttctcctatatcccgctcagcctcgttgtgatcgcagttgtcatttgtgcgggggtcgcggtgatttccggtatgaatccggcccgcaaagcgacaaaaaccaacgttctgactgcattaagaagagaactgtaaaggaaaaaagccggctggacatcagccggtttttcctctatctatcagaaaagggcggataccatgtttcacattttgttaatagaagatgataacactttgtttcatgagatgaaagagagattaacgggctggtcatttgcggtgcacggaataaaagatttcagccgggtcatccgggagtttaccgaaatcaagcctgatttggtgatcattgatgtacagctgccgaaatttgacggctttcattggtgcagaatgatacgttcccaatcaaacgtgccgatactctttttgtcctcgcgcgatcatcccgcggatatggtcatgtcgatgcagctcggggcagatgattttattcagaagccttttcactttgatgtgttaatcgcgaaaatacaggcggtgttccgccgtgtgcatcaatacggcacagaaccggcgctgatgaaaagatggtgcggggcggtcattgacacagaaaccaacacggtcagccgtaaaaacggttcggtcgagctgaccaaaaacgaaatgctgatcttaaaactgctggctgagcagaaaaataaaatcgtcagccgggaagaactcatcagaagcctatggaatgatgagcgtttcgtcagtgataatacgctgacggtgaatgtcaaccggctgcggaaaaaactcgatcaattaggcatcgggaaaatgattgaaaccaaggtggggcagggatacatcgcaaaggaagaagacggtctttatgattaaatcatttctgctcgaaagaaagagctggatcgcgatgtttcttttgcagcaggctgtgcttctttttgcggcatatattgatccgtctattccgtttttttcggtgctgtatttcgtttacctgtctcttcttgtgtttcttgtatttctcttgttccgctatcgtaaagagaccgcctattataaaagcttaagagagtgggacgccaatttagacatgtcttatcttaaagcgcctgacagtccgtttgagtctatcgttgaagaaagcattgaagggcagacagagcagttaagaaaaagctcacttcaccttcaggcggcgtcagagcatgaaaaggacgatctgatgtcatggattcacgaggtcaaaacaccgctgacagcgatgcatctcatgatcgagcgccttgatgaacagccgctgaaagcccctttgctgtatgaatggctgcggattcaccatctcctggaccagcagcttcatcagaaacgattgtcctttattgaaaatgatttatcattccagcgaattcagctcagaccgctcgttttcaaagaaattaaaaatctgcaatcatggtgtatacaaaaagggatcgggtttgacattcagcttgattcaccagacgttcacagtgacggaaaatggctttccttcatcatcaggcagctgttaagcaatgccgtcaaatacagtgaggcggatgacattaccgtaaaaagctatgaacaaaacggccgggtgcatgtggatatcgaagaccgcggcatcggcatcgagcccaaagatcttccgcgcatttttgaaaagggatttacctcgacgcgaatgaggcgtgatcacgcgtcaacggggatgggcctgtatttggctcgaaaagccgcggctccgcttcttatccagatcagcgtgcgctctgagccggaaagcggcacggtttttaccttggtgtttccgaaacagaacgatgccgtcagcatgttcagcgtgtgacaaaagtgtcacatgcttttctcttttgttcgcttaatcaaacgaaaaaaacggcttctgtttttaaaataaagataaccaatgtaaaaggagaatcagaacgtgatgattttagaagcaggcaatatccaaaaaagctacggaaacaagctgaataaacaagaggtgctgaaaggaattgatcttcagattcacaaaggggaattcgtcagcattatgggcccgtcgggatcagggaaaacgacccttttgaatgtgctttcctccattgataaagtgagcgcgggcaccattaaactgaatgagacggagattacatccatgaaagaaaagcagcttgccgaattcagaaaacggcatctcggctttatttttcaggattataatttattggacaccctgaccgtgaaggaaaacatacttctgccgttatccattacgaaaatgtctaagaaagaggcggacctgcgatttgccgagacggcagaggagcttgggatctatgatttgagacataagtatccgagtgaaatttccggcgggcaaaaacagcggacgtctgccgcaagagctgttattcacgagccgggcattatttttgctgatgagccgaccggagcgctcgattcaaaggctgccacggatttactgaataaactcagccgtctgaatcaaaaacgccgcgccaccattgtgatggtgacgcatgatccggttgccgccagctattccggacgtgtggttttcattaaagacggccgtgtgtatacacagctgaataaaggcggtcaggacagaccggacttttttcaggatattatgaaaacgcaaagtgtattgggcggggttcaggcatgagtattcatcatttgatcttccagaacctgaaaaagaatatgaaaaactattacctttacgtttttgcgctggtgttcagcgccgccctttatttcgcgtttgtcacgatgcaatacgatccggcgcttgatgaaatgaaaagctccataaaaggagcggcggcaatccgggccgcctctgtactgcttgtggcgatcgtgtcggtatttcttttatacgccaacaccatttttattaaacggcgcggccgggaaatcggcttattccgattaatcggcatgacgaaaatgcacattttccgcatactcagcacagaaaatttcattttgtatttcggatcgatttggatcggtatttttgccggcttttctctctcgaaattatgtatgatgatgctgtttcatacagtcggtgtgaaagcctctgtctcactgtttttttcaagcaaggcgctcgttcagacgttaattgtgttcggggcgatttacgtgctgattatgatgatgaattacttatttattaaacggcaaagcattttgtctttatttaaaaccgcgtcatcgtcagaaagcggcataagacggctttcttgggtgcagatgtcgatcggtgttgtcggtattgcggccattatcgccggctatgccgtgtccgcggatttattcggaggcagttttacgagcatgaatgaactgttttcggccatggtgtttattctcggctcggtcattatcggaacctatctgttttataaaggttcggtcagctttctggcaaatctcatccggaaatcaaaaggcgggtatctgaatgtcagtgaagtgctgtctttgtcatccatcatgttccggatgaagtcaaacgccgtcctgctgacgattattacgactctttcggcgctggcaatcggtttgctgtctttaagctatatctcgtactattccgcggaaaaatcggctgagcaaaatacagccgcggactttgcgtttgataaccaaaaggagactgactcatttaccgctttattgaagaaaaatggaattgaacacaaagtgaaaacaatcaagaccattcaagccggtgtcaatatgaagaacatcataaacggcgacatgaaaagctttcaacaagacccgtccagcttggcgctgccgattataagcgagaaagacgcagaagggacggagctttctgacggagaagccgtgtttaccggatataatgatatgatgaaaagatttctcgacctgaaaacgtcaggttccattgatataaacggcaaaacggataaaataccgctggcgtataagggcttgaagaacgacttccttctgtcatatacatttacaagcggagggctgccgaccgttatcgtcacgcagcaggtatttgaccggatcgagaaagatatcgacccgtccattcagggaaaatcaaatcggtttttcggcattacactcaaacgtgaagaggacatccaaaaagctgatggtctgtttcaggcgcagcactattctgacggcgcgctttcacaatttgaaacggctgacacccaaaagaaaaacatggggctgatcatgtttattgtcggctttttggggttaacctttctgatcacctcaggctgtatcctttattttaaacaaatgggcgagtgtgaggatgagaaggctgattacacgatattgcggaagctcggcttcacaacgggggatctgctgaaaggcatccgccggaagcaggcgtatcatttcgggattccgctcgttctcgggctgttccacagctattttgccgttcagtcaggatggtttttattcggaacggaagtgtggacgccgatgatcatcgtcatggcgctgtatacgctgctgtactccatcttcggcatgctgtcggtgctatactataaaaaggtcattcaatccgcattgtaaaacaagttgaggagcctccgcataagcggaggctttttttgtatgaatagaagaaagcgatttttaaaagaatagacatacgtcattttctcgcgcgggggagccttatgcagaagtattttcaattgaaatctgaaacaggagcctttcatcttttttccaaggaacacattttcacgcttttggtcatcggattgcttggggtgtgcgtgatcatattccggaaacagctcaatcacggccggccgaatcgcgttttccgctatgtactgttcattctccttgccgtgtcgcagatcagctatcatatatggctgctttgtcatcatgcctggtcgctgaaaacagctctgccgctgcagctgagcgacctttccgtctatttggcaatgctgatggtcatgacaaaaagcaaaaaactgttcgccttcctctattttgccggtttgggcagcgccgtacaggcgatggcaacacctgatttaggggcgtattctttccctcattttcggtacatcgtgtttttcgtctcccacggctgtgtttttcttacctgcctattcatggccgcttcagaaaggtacagaccgtcggcgcgcggactgtgggtgtctgtgctgatcgtaaatctgtacggggcgtgtgtcttttttattgatcgtgtgctgaatgcgaattacttatatttaatgaaaaaaccgaagaccgcttcgcttctgaacgttttcggaccttggccgtggtatcttctatcaatggaagcggcggtgatattgagctttttcattctgtatattccgttttggctgctgcggaaaagagcatgaggccggcctgtttttgtgaatccaatcatttgtaattttttcaacattccggcattatttttttcagattctgatgttgaaaaaagacgtccgcggcgatagaatgaatgtgctatgataacgtgttcgatacggagccgcggcttgcggtttccgttttttcatggggttttttatagagagagggggatcggtatgccgcgcgctttgaagatattaatcatcggaatgtttatcaatgtgacgggcgcatcttttttgtggccgctgaatacgatctatattcataatcatttagggaaatcgctgactgttgcgggggttgttctgatgctgaattccggggccagtgtggcggggaatttatgcggcggatttttgtttgataaaatcggcggattcaaatccattatgctgggcattatgatcacattggcaagtcttctcggactcgttctgtttcatcaatggcccgtttatatttggctgctcatcattgtcggcttcggttccggtatcgtgtttccggccagttacgccatggcgggagcggtatggaaagaaggcgggcggagagcttttaatgcgatttatgtagctcagaacgcaggtgtcgccgtgggctcggcactcggcgggatggttgcggcgtactcgtttacgtacgtgtttttagccaatgctatgctgtatgtgctgtttttccttatcgtatttttcgggtttcgaaatatcaaaacccaaaatgcgagccaggtttctgttctggactacgagcctgtcagcagcagaacgaaatttacggcgcttctcatattgagcggcgggtatgttctcgggtggatcgcctattcgcagtggtccacaaccgttgcgtcacatactcaaagcatcggtatgccgctttcattatacagtgtgctctggaccgtaaacggaatattaattgtcgccggacagcctctcatgggagctgttctgaaaaaatggtccggtgcgttaaaaacgcagatggtcatcggcttttgtatttttatcgtctcgttcggcgtgcttctcagcgccaagcaatttccgatgtacctcaccgcaatggtgattttaaccgtcggagaaatgcttgtctggcctgccgtgcctaccattgccaatcagcttgcgcctaaggggaaagaaggattttaccaaggattcgtcaacagtgcggcgacgggcggcagaatgatcgggccgctccttggcggcgtgctggttgatcagtacggaatgagcgtgctgctgttgatcctgatggtgcttcttgttgtcagcatcgcagcgacggtgctgtacgacaaacgcctgaaaaccgttaataaacaaaacgtccaagtgcgatgacgacataaaaaaatcccgctgtttcggcgggatttttttgtttatacgaccggaagcacgttgaccgcgtccttaacgtttaaatacgtctttaatgaagaaaagctggcatcaagctgattcattctcatggcgagggtaggcttgatcccggtgataatcaattccgtgccgattaatttaagcaggtggtgcaatttgaaaatccggtctgcggtctgttcgtttacctcggccagacctgataagtctataattaagtaatcatctttagatgcggttaatatgtccgtcaaagttgtcacaattgaatcaaatcgttcttccgttaagtttcccactaacggcaaggcggagatgccgtttcggatcggaacaatcggtgtagacagcgtcgtgatttctgtgagggaatcctcaaggagcttttcgtattctttctgctctgtaatgtctttttgaaaaccgacaaaatagagcttgtcttcaacataaagaggatcaatgttgagttcattccaaaacggggtgccgtcttttttgacatttttcagccgcaccgtgatcttttctttctgggttaagctctttctgattttcgcgacttgttgacggtcggtttctttgctttgcagaaatctgcagttcttacctaatatctcttcggaagagtagcctgtcatatccataaatccctgatttgtatatatgatgggattgtcctcaagagaggggtctgtaatcaccacgccgatgcgtgcgtgatcaagcgcctttttgataagctccagctgctccagttttccgaatacatttgagtcagccatgtaaaacccccttttggccgtaaagctgcgcgctttttcagccattgtttctcccctttttaaatgaatctacagtaaccgtagcataacatatgttctgattcaagcagccgaagtttgcaatttgtcattcgggcttgtcctcatatacactgaatatataaggggaaggcacatcatcgctaagtaagtgactaggtcattgtcactgggtgaaaaatgaatctaatgcatcaagcttaccgatcatgtgttcacatataatggaagaaacaagctttttactttcctgctcaatcgccggtatgtagatatcgaaaatcatcgtattcgtaagggggctggatggcctgaagtcgctttactaaataagggctttaggaaggtgatgaagatgctgcatcaggtaataattgcttgtgtaattggaggaatcatgggggttctcggtcatgtgaaaaagagaggcaggctggagaaacccagaatgacaaagcggtttatctatctcggttttttggaagatggttttatcggaatggctgcttccatcttacttgtcttatccgctgaccccgattcaggaattcaactcgtcatcttatccataatcgcaggctacggcggagaagctgttctcaggagctttgattttgtcagagaacaaaacagtaattcggccgaagcaaaaccacaccagcaaaaaaatcctccatcaaaataatatccccgctcatgacccgttccgggtacattcccattgtatacaaacctgcttgcacttatgaacagaattctataaaatacaggtaagattacggtagcgataagaacagtgaagaggagcagtaagaagcagattttgcaatcagagagttgacggccggtgcaagtcaatcaagtctgtttccgaactcgcctcagagttgcagcggcaaaaccgctgacgcataactgcgttaaaagtatcaagtgagtgcggctcaaaaccgtgctaacgagggtggtaccgcgggaaataaaaatctctcgtccctttttgggatgagggagtttttttagttttagaataatctgaatataatctttctcatcccgtcaatacttggactacatacgccgtattcaatcagaaggaggtttttacgttgagttttcagcacgaaaaaatagaaaagaaatggcagaattactggttggatcataaaacgttcgccgtcagtgaagagaatgacaagccgaagttttacgcgcttgacatgttcccgtatccttcaggagccggccttcatgtcggacatccggaaggctatacggcaaccgatatcctttcgcgcatgagacgcatgcaaggatacaatgtgcttcatccgatgggatgggacgcgttcgggcttcctgccgagcaatacgcgcttgacacggggaatgatccggctgagttcacaaaacaaaatatagataatttccgccgccagattcaatcgctcggattttcatatgattgggatcgtgaaatcaatacgactgatccggactattacaagtggacgcagtggatcttcaccaagctgtacgaaaaagggctcgcttacgtagacgaagtgccggtcaactggtgcccggcgctcggaacggtgcttgcgaacgaagaggtcattgacggcaaaagcgagcggggcggccatccggttgaacgccgtccgatgagacaatggatgctgaaaatcaccgcttatgcggacaggcttcttgaagatttagaagaccttgactggccagaaagcattaaagacatgcagcgcaactggatcggacgctcagaaggcgcaaacgtgcatttcgcgatcgacggcactgatgacacgtttaccgtgtttacgacaagaccggacacgctgttcggcgcggcttatgccgtactggctcctgagcatgagcttgtggaggccatcacgacgcctgaacaaaaagaagcggtagacgcttatgttaaagaagttcaggcgaaaagtgacctggaacggacggatcttgcgaaaacaaaaacgggcgtcttcacgggcgcatatgccgtaaaccctgcaaatggggaaaagctgccgatctggatagcggattatgtcctcgcctcttacggaacaggcgctgtaatggccgtgccggcgcatgatgaacgtgattttgaattcgcaaaagtgttcagcctgcctgtcaaagaagtcgtaaaaggcggaaatacggaagaagaagcgtacacgggggacggagagcatgtcaattccggctttctgaacggactgaataaagcggaagcgattgaacaaatgatcgcctggcttgaagaaacgaaaaacggtgagaaaaaagtgacataccgtctgcgtgattggctgttcagccgccagcgctattggggcgagccgattccggtcattcattgggaagatggcacgtcaacagccgttccggcggaagagctgccgctgattctgccgaaaaccgatgagatcaaaccgagcggaacaggtgaatcaccgcttgccaacattaaagagtgggtggaagtcactgatcctgtaacgggcaaaaaaggcagaagagaaacgaacacgatgccgcaatgggcgggaagctgctggtatttcctccgctttatcgacccgaaaaatccggatcagctcgcttcacctgagaaactggataaatggctgcccgttgatatttacattggaggagcggagcatgccgtgcttcaccttctgtacgcgcgtttctggcataaattcctctacgatatcggtgtcgtgccgacgaaagaaccgttccaaaagctgtataaccaaggaatgattctcggggaaaataatgaaaaaatgagtaaatcccgcggaaacgtcgtcaatccggatgaaattgtggcgtctcacggagcagatacgctccgcctgtacgaaatgtttatggggccgcttgatgcatctatcgcctggtctgaatcaggtcttgacggagcgcgccgcttccttgaccgcgtatggcgtttgtttatcgaggaaaacgacgagctgacgggcaaagtgacagaaggcgcgggcgaaactcttgagcgcgtctatcatgaaacggtcatgaaagtgacagaaaacttcgaagcccttcgttttaatacgggcatttctcagctgatggtcttcattaatgaagcttacaaagcgaatgaactgccgagagaatatatcgaaggttttgtgaagctgctttctcctattgcgccgcatttggcggaagaactgtgggaaaaactcggccacgaaggttcgattgcatacgaggcttggcctgcttatgacgaatcaaaactggtggacgatgaagtggaaatcgtcgtccagctgaacggaaaagtaaaagcgaaattaatggttccggctgatgctgataaagcagcgttggaacagctcgcacaagctgacgaaaaagtaaaagagcagcttgaaggaaaaacgatccgaaaaatcattgccgtaccgggcaagcttgtcaatatcgtggcaaactgaccgggcgaagcccctctcctacagagaggggcttttttatcagcctctatcatagaaattgcacagcgggctttggtatacttaacaccataaagatgaatgggagtgtcacacattgaaaataaatgaaatcagcacagccgtactggaagaaaaattaaaagcgggagaagagctgtatctgattgatgtcagagaagacgaagaagttgccgaaggaatgattccggaggccgttcacatccgcatgggggacatccctgagaagatggatgcgttagacaaggacaaggaatatgtatttatctgccgttccggaaaaagaagcatgaacgtttgtatgtatttacatgagcagggcttccgtacggttaatgttgaaggcggcatgctggagtgggaaggcgaaacaaagccgaagaaataacgctttgaagtgaaagaagaaaagggacgtgcgtctttttcttctttttttataaaaaaacgggaggcgaatcaggtgaaaccgatgatccgcgcgatgaaaacaaacgatatcaaacaggtccggcaagtcgcagaacgaagctggcatcatacgtatgaagggattattcccagacacattcaagatcagtttctcgaatccgcctatcaggatgagatgatggaacgccggctcttgcattctctgttctttgtggcagaagaagaggggcgagtgctcggttttgcaaatgccaccccggttcaaaaagacggaaatgcggagctgaccgccatctatattgacccggattgccagggaagcgggataggcacggcactccttaaagaaagcatcaggcagtccggcggggtaaaaaagctttatgtccatgcagaaaaagagaaccgcattgccttatccttttatcaagcgaaagggtttcaatgggtatgtgaatttgaagaagattttaaaggacacactttacagacggtcaaactggtactgaacatataaaagcgtccggcccgcccaaatggtcagtgataagccggaagccggtctttgtgcgcttcaaataagtcatcgcacaaagatatgatgtcattcatggaaagctcggcgcttgtatgcgggtcaagcatggccgcctgatatacggcttccttttttaatgtaacggccgcttcgatggttaaaagctgtgtgttaatgtttgttctgttgagcgccgcgagctgctccggaagttcgcccgaatagcacggcataatgtggtttttgacggctgtgcaaggcacttcaacgaccgctttcgccggcagattcggtatcagcccggtattcagcacattgccgccgaatgtgaacggtttgcccgtctccatcgcttcaataattctcgaaccgtattcttttgagcgttcgtgcgtcaggttttggttgttgatgatgccgtctctcatcgtttcccaattgttgatttgttccgcgcatctcctcggatattcatcaagcggaatttggagttcatctatcagctcaggataccggctttttataaaatacgggtgatattcggcattatgctcagatgattccgttacgtagcagccgaatttatccatcagctcaaaccgcaccatgtccttatgtttcgtcttttgtttttcgcgtgcccgtcttttaatttcaggatataaatcaattccgtcttttttaatctccaaaagccaagccatatggttaatgccggcaatgcgttcttccgtcccttcgtgatccatgccgagtgagtcaaacagatctttggtacatacctggacgctgtggcacaggccgaccgttttgacattcgtatgtctgagcatcgctccggtcagagaggccatcggatttgtatagtttaacagccacgcatccgggcagacctcttccatgtcttttgcgatgtcaaataaaacggggatggtgcgaagggaacggaaaatgccgcctattccgacggtatcggcaatcgtctggcggagaccgtaccgcttcgggatgtcaaagtcaatgaccgtcgcgggtttatagcctccgacctgaatggcgtttatcacatagccggcgtgtttcagcgcctgttttcggtcatcgtaggagatgatggatatactcgtattgtagcggtctctcatgttttccagcatgagctgggattctttcagccgtacagcgtcaatatcataaagcgcgaattcaaacccgtttaatgcttcagtcagtaagcagtcccccagtacattttttgcgaaaatcgtgctccccgctccgataaacgtaattttcttcaacagaaattcctcccttttcttctcagcctttgaccgccccggaggacagccctgagataaaatatttttgaagcgccaaaaacaatacgaccatcggcagcatcgccataattgcggctgcggcgactaagtgaagattgttcgcgttttcgccgaaaaatcccgccatggccacagtcaatgtctgcaccttttgatcttgtaaaaagaaaatcgcaaattggtaatcgttccagataaacacacaggaaataatgcagaccgttgcggtaatcggtttcaacaaaggaaacacgattgtataaaaagtcctgatcaatcccgcgccgtccatcctggcggcttcctcaagctctttcggaatggaagagcggataaaccccgaatataagaaaacggtcagcggcatatatgcagccgtattaatgagaatggctgcggcatgcgtattgatcagccccgcatcagcgaccatcttgtataaaggaaccatggaagtcaaaggcgggatgatcatgattgaaatcaaaaggccgaagacgattttgttcagctttgtatttcttcttgcgagcgggtatgcggcaagcgaacccatgaaaattaataaagcggcggaaacggctgtaatgataatcgtgttcagaaaggattgcccgagagaggcacgttcccatgcttcacgaaaattctgaaatgaaaaggcggatggcagcgaccattttgaactgtagtcaccttttgcttttaatgacgtggtcagcaaaatataaaaggggacaatatgaacgcacgagataacggctgccaacagcgtaaaaatccgcattcgggctgttttcatgacatttccgtctcctttcgcttgaaatacacgagagccgaaaagctgatgacaagaataatgacggacataaacacgccttgggcggcggcatatcccgcatcctgccgtttaaaatataaatcatacataaacgttgacatcgattgagaggaattgcccggcccgcctgcggtcagcgcgaaaatgacatcaaacagcttcagcccgccgatgatattgatgaccatgttgatggtgacagccggcatcaataaaggcagggtgatggtgaaaaacggctgaagacctcccgcgccatccatttttgcggcttcgtaataatctttcggaatgctttgcagccccgccaaatatacaatcatcgcaatgcctgcgtattgatatgtgttaatcatgacgataatccacgggtttgccgcagggcttgccaaggcgttgacaggaccgattcccagtgcgccaagcacatcattcagcgcacccccgtcatatgagaaaataaaataccaaatgtatcccataatcagcggactgataatgacgggcaggtagacgatcgttcttgtgagcgccttcatttttaagctctgattcaaaagcagcgcatataaaagtccgagcatattctgaaaaaaagtgcttccgatgccgtaaagcaaagtgtttttcacaacaagccacgtgtccggatctgtaaaaagccttttatattgagtaacccccacccattgatacgtctgtgagaagccgttccagtttgtaaatgtgataaaagcgcctttgacaaacggaaaaatcatgaaaataaaaaccgtggcaagagcgggaacgtacatccaccacagtgacgcgggttttaccggcttttgatgttgaaatccttgggtttcttttgcaagatcactcattctttttcagctccccatgaatcagattgaagccgaagccgcttatattccctgccgagtttcgctgaaatttcagcgggggttaagatatcggccatcagctcctgcccggctgttcccatcacatcccacattccgttcggcaaataaaggcggtcaaaataaggctgcaccttaatatgctgatagcgcttatagtcatttgcgtagaaaatgtccgtttgcacattcactaatccggccggaagcgaggtcgcttcggcaattgattttgcatgctcgggtcgggccataaatgcgataaactgtttcgcttcttcaagccgcggggaatccttgaatgccgccagcgtgtaacgttcgcctccgatccaaaccggcgcgtctcccttatggacggccggggtcggtatgatgccgacttttaccttcggattgatttgagcgacgtcttggccgagggtgccgccctgcagcgtaaaggcgattttgttttgcgccatcagttcaatgagctgggaccgttttgccgtcacggcatctatattgagcaggttttccttttgcatctctttcagtttgtcagataaataggtgaagtgtgtccagcggaaggttccgtttaacagttgttttttgtaacggtgtgcgggatctgtgatgagaagcggtgcggcgaattgatcgtaatattgggcaaatgagcttttctcatagccggcaaaccagaagggggtgactgttccgccgcttttttctttaatctgtcgcagtgccttcataaaatcatccattgtttccggcggtttgattccgtatttttctaacaacgtacgattgtaggccagtccgtcctttgcctgattcagagggaaggcgtatattctgcctttggcgtctttgagcatgctgtttaaattcggatcgagccgcttcgtccaagacatgccgctgaggtcggcggtatattctccgtagcggattttggcccagccgtgtgtgtcgaaaagatcgggcatatcaccggccgccatcctgaccctcatcatattttcgtagtcattgcctgggaaatgaacgtttacttgaatgtccggatgttctttttggaatgaatcagccaactttctgaatacggcgcgttcgctgtctgaggatatggtggaatagactgtcaatgttttctgcttttctccggcgccgctctgttctgccgagcagccgggaagtatcatgcaagtaaaagaaagaaacaaagccagtaagcgtttcatcttttcctcctttaaatatgatataaacgctgcgggacacgtcaccacctttcttgtgagccgcagctttgtctgacaatcaatgaagtggggagcgtcacggccagcgggacggttctgccgtttaaacggtcgagaagcaatttgacacccgtccggcccatctcttccgtgtatacttttaccgttgataacggcgtgctggcgtattctgcctcatcaattccgttgaagctgacaaccgccgtatcgcgcgggacttgaaggccggcttcctgcaaggcttttaaagcgccgacagccatcgaatcacttgcgataaaaaaggcatcggggagacttccgcctttgacggcttcattcatcagccggaacccttcgtgcatgctgtattcgccgatcagtacatgctccggctcggcgccggccatttgtaagaaagcggtcagacgcttatcctcaatcgttttattgctgtttacaccgtctatgacggtatgttcccgctcccggccgccgatataaccgagccgctggtaaccgagcgacagtagatgttctatcgccttttgcgctgcggcataaaaatccacgctgacggaatcgtagcgggcgggatcgggggtgccgttaacaaataccgcgtgcctgaaagcggcgctgatattcgtaagcgcctcgtcttgcaggctgccgatgacgatgacgccgtccagttcgtgaaacatatgctcttgaaaagaaccgagatggatagaagatgtgataaaaattttttgccgaaagcattcttcttcaatgccttttcggatcgccgaaaaataaggatcctgccgttcttcttccggtgacaggcagctgacaacgccgatcaggggcgctgaatcgctgcggctgcggttcttccgtttttttgccgacggctgatagcccagctcatcggcgatcctcagaactttttctcttgtttcatcagtcacagccaaagagtcatccttattcaaaattctcgatactgtcgcgctggatacagatgcctgtaaggcaatatctttgagacggaccatttcgcatctcctttttactaaatatttactaaacagaaatgacctggttattgttaaaatgatattatcatacgagagtaagcgttttcaataactatttttggttacttttagtaaaaatcagtaaaaaagaaaatctgtttttctctatcatatttcaattgaaccggaataaattgatagagaaaggagagggtgatgtgctgaagatagctgtttttgatgaggagcatgaaaaggatctgcagactgaagtcaatacatttttaaaggggatttctgatgaacagctcgttgatattaaatatacggtagcggcggcctgtgatcctgaaggtgagcagctttattgtttttccgctctcattttataccgaaaataaaaaagcccggacgaaatgccgggcttcgttgttcattatgcttttttgacgcggggacttcttggtttttggtatttctccgcttgtttgattccttttctctcgctcgctaatgacttgtacagagacacgatcatcagaaggatcacgactgaaaacggaaccgcggcgagaatggccgtgttttgcagtgcggccagaccgccggaatataacaaaaccgctgccacggcggactggatgacgccccagatgattttcacccggtttgacgggtctaaagagccgtaagacgtttgcattccaagcacaaatgtcgctgaatccgctgatgtaataaagaatacagcgatcagaacaagcgttaatacggatgtcaccattgtcagcggatagtggctgagtgcgccgaacagcatcgtatccgttgacattcccgcgacattgaatacgcctttctgctgaagatccatcgcggatacaccgaagatcgcaaaccataagaaagccaatatacaaggtgtcaccaacaccccgattaaaaattcccggatcgtccggccccttgatacacgggcgataaaaatgccgacaaacggcgaccaggatatccaccaggcccaatagaaaatggtccagctgttaatccattcgcgtttttggggatcattcggagacaagcgaaagctcatctgcacgatattttggatgtattggccgatagaatcggtaaatgagttcataatcagcaccgtcggacctgcaatgagcataaagatcattaaaatagccgcgagcgccatgttggtattgcttaagtatttaatccctttgccgattccgctccacgcagaaatcaaaaataacacggtcacgacagcgatcaggatcagctgaacggaaaatgttttcggaatgccgaataaataatgcaaaccgccgttgatctgagtcgctccgagccctaagcttgtcgccacaccgacaacggtcgcaaacacggcgatacagtcaatcgctttgccgatcgggccgtttactttatcgcccaaaagcggtgtcagtgtgctgctgatcaaaccgggcgcgtcttttctgaattgaaaatatgcgatacataaagcgacaaccgcatagatggcccaagcgtgcagcccccagtggaaaaatgtgtaccggagcgcatcccgaaatgcttggggcgtttctgtttcacctgagggagagctgatggcgtaatggctgatcggttccgcagccccgtaaaataccaaaccgattcccatgcctgcgctgaaaagcatggcaaaccatgataataagccgaattccggtttttccccgggttttccgagttttattgtgccgatcggacttacaatgagaaagagacagaaaccgacaaatatagaaacgaccagcagataataccagccgaaagaatccgtaataaatttttgtgccgtatcagtgacttgctgcaggctgtcaggagaaatggccccccataaaaccgcagcggctgtgatgacaatcacaatccaaaaaacactggagatgttcttcttcaaacgttctcaccctctgactatttttttcaatacgccattttgttttagtatggtcgtacgattgcagatcaatcctttcttcctattccctcaatcaggtgaaacaaaacgcagaaaactctatcatgtttttggtcaattatcaatggggacgctcaggtaaatgcgctttaaaccatttagagcgagcgtgagaaacgtcctgcattcaaaccggcgagacgccctgtgacaaaggctgaagtgatattgtagcccccggtatagccgtgaatgtcgagtatttctccgcaaaaatataagccttccattttttttgacgccatttgtttcggctcaatctcttttacggaaacacctccgcctgtgacaaacgctttgtccaaagaaagcgttccgtcagcggcaaccgtaaattgtttgcagtctttgacaaaagccctgaattgatccttcggcagttccgtaaagcttgtctgcggatcaagaccgttccgttccagaagaaaaagcaggtaccgttcctgcatccacggcttcagcgcatttttgagcgcttttttcggtgcgtctttcagttccttgtgcatcttttgaaataactcttcctcgttgatgccgggaaacagatcgatgcggagtttgacctctggctgctttttcagttctttgacgacaaactggctgcagcggagaatggcggggcctgacaagccgaaatgggtgaacagcatgtccatcacgtgtgtgacgattggtttgccttttttattcaggacgctgacggccgcgtttctaagagacagcccctgaagtgttttttgtttaataaacggttctgacgacgtaaccggcacttccgtcggaaagagttcggtcacggtatgaccggccgcttccgcccatgcatagccgtctccggtgctgccggtatgcgggactgattttccgccgaccgcgataataacggcgtctgcgttaatgtgttcgtcattgtttgtcgtaatgcctgctgtcctgccgttctcgtaccgcacttctttgattttttcatttgtgcggatggtgacattcagttgttttaatcggtttaaaagcgcatcgacaacgctttgcgctttgtccgtcaccgggaacatgcgcccgtggtcttcttctttcagctgaatgccgagtttttcaaaaaaggcgatgatatcttcattattaaattcggaaaacgcgctgtataaaaagcggccgttgccggggatgtgtttgatgatttcttcaacggggaggcggttggtcacgttgcagcgcccgccgccggaaatcgccagcttccgtcccagcttgtttcctttatcgattaataatacgtccgccccttcttcgcctgccgcaatcgcagccattaaaccggacgggccgccgccgatcacaatcacgtcataatgtttcatctttcatcaacaactttctttttcacgtataataggcggaaatgtccgctttctgctattatagcgaaagaaagggaatccttaaacgtattttgttttttaaagagttttcccaaaaagtttcccgctgtaattattaccgtctaattgcccagttgtgttaaaatagaaaagttgaatcttcgtagaaaatggtgatgaggaaacatgtcaagcaaattgttaaggggcacgttcgtgctgacgctcggcacctatatatcgcggattttagggatgatttatctgatcccgttcggagcgatggtcggagcgacgggcggagctttgtttcaatacggatataatcaatatacactgtttttaaacattgccacgatgggatttcccgccgcggtttcaaaatttgtctcgaaatataattccaagggagactatgagacaagcaggcggatgctgagagcgggaatgtcggttatgctcgtaaccgggatgatcgctttttcaattctttatatttcggcgccgttttttgcggaaacatctctcggcggcacgagtaacaacggacttacgattgaccacgtcgtttatgtcatccggatggtcagtctggcacttttggtcgtgccgattatgagtcttgtgcgcggttttttccaaggtcatcagatgatggggccgacagccgtttcacaggttgtggagcagcttgcccggatcatctttttattgggcgcaacgtatttgattttaagagtgatcaacggcggccttgtcatcgcagtcggatacgcgactttcgcggcgctgatcggatcattcggagggcttgtcgtcctttatatttactggaataagcggaagggcgatcttctggcgatgaagccgaatctcgtccggtctgcgaacttaagttataaaaaaatgttcattgagcttttcagttatgccgctccttacgtatttgtcggactggcgattcctttgtattcgtatatcgatacgaatacgtttaataaagcgatgattgcggcgggccataaggatatcagccaggacatgcttgcgattgtcaccctttatgtgccgaagcttgtgatgatcccggtttctctggcgaccgctttcggtctgacgctgattccgacgattactgaatcgtttacgagcaggaattataagcttttgaaccagcagattaaccagacgatgcaaatcattctgtttttggttattcccgccgttgtcgggatgtccgtgttatcgggtccggcctatacgtttttctacggctctgaaagtcttcgcccggatatcggacaggatatattgttctggtacgcgcctgtcgcgatactgttttctctgtttaccgtaaacgccgcgatcctgcaagggattaataagcagaaatttgctgtcgtgagtcttttcatcggcgttattataaaagtggtgctgaacgtgccgctgatcaagctgtttcagggagacggggccatcttggcaacggcgctcggttatatcgcttctcttctgtacggttttattatgattaagcgccatgcgggctattcgtatacggtacttataaaacgggtcattttaatcgcggtcctgtccgtcgtgatgggagtcgcggtcaagctgactcaatggctgctcagcttctttgtaacataccaaagcggccaggtgcatgcggcgattgtcgtctttgtctgcgccgctgtcggcggtgcggtgtacatgtttgccgcgtaccgaatcggatttttacagaaaatgtttggaaaccgtctgccccgcgttttgaggagaggcaggcattccgcccattgagaaataatgaatagtccgcttatcgcgggcttttctttttaaaggagaggatcaggatgagacttgataagctgcttgccaacagcggattcggctcaagaaaagatgtgaaaaaaatcgtcaaggctggggctgtcatgattgacggagagccggcgaaagatgtgaaaacccatgtcgatccggaaaaacaggacatcacggtatacggagagccggcagactatcgtgaatttatttatgtcatgatgaataagccgcaaggagtgctgtccgctaccgaagacagccgccagcaaacggtggttgatttgctgacgcctgaagaacagcgatttgaaccgtttccggcgggacgtcttgataaggatacggaaggctttttgcttctgaccaatgacgggcagctcgctcatcgcctgctttctccgaaaaagcatgtgcctaaaacatatgaggtccggttaacctcgcctctgtcaccggaagacatcgttcatctggaaagaggcgtcgtcattgaaggaggctataagacgaagccggcagccgttgaaatcattacagaaagcccggatgaaacggtgattcacttgaccattacagaaggcaaatatcatcaggtgaagctgatggcaaaggctgtcggaaatgaagtggcttatttgaagcggctttcgatgggggctgtttctcttgacccggatcttaaaccgggagaattccgcgagctgactgaagaagagctcgaaacgctgagaggcgctgaagtgtaatcgatatcagaaaagcccaaaacagatttgttttgggctttttatatagaggaacaaaaaacaaggcaaagacgctgctttgccttgcagcatgtcaggccgaaaagggccttatgtaattgttcgcttaagatgtaattttcactttttttcgtgttgtctcccacttgcctcggctaggactatgaacaagatcattgtatgctaacacatttaagtctcgctgaatggttctaggtgtaatgccgaattcatcaaccagttcctgtgttgtcacaaggcctttttcctggatgaacatgtaaactgatttaatccgagtcagcatacgatttgttgaaggtttcaaaaaaccactccctatcataagatcggatggacttgatataccacaactttcgactctaaaacttcgtacgaataagcaacaaaggatgacattctgttttttctcttttaactgcctccattatacacgatatggacaacatgaatctaggaataagcgcagataattttttccaaatgggtgccgccttggtgcattactatgcccggtccgcttttattattatggaaactgaaactttttttatacatgtccgtatgaaaacgggggagtgagaagtttgggagaattattgaatgcaaacattgtctgcgccggttatgctgacaggccgaaggtgatttctgatgtatctctgtcagtcaacgctggtgaaattaccggtttaatcggagcgaacggcgcggggaaaagcacagtgataaaggcggttctcgggctgtcccgggatatagagggcggaattgagtggaatgattcatcttatgcttacataccggagcgtccgagtttttatgatgaactgacgctttgggagcatctcgagctgaccgggtcattgcggggcatggaaggggaagagtgccgtgagcgggcagggcggctgcttgaagagttttcgctgacgtctgtaaaacatgatttgccttccggtttttcaaaagggatgcagcaaaaattgatgctcatacaggcatttttggcgaagccggatatttacatcattgatgagccttttatcggacttgatccgatctcaacgaagctgtttaccgacatgctgattgctgagaaagaaaggggcgcggggattttgatgtgcactcatgttctggatacggcggaaaaaatctgcgaccggttttatttgctggatcagggcgctctgcttcttcaaggcacgttagaggagcttcaggaaaaaacggggagccgttcactgctggattgcttttattcagcggttcggagcagtcagcgatgaccgggcgggctttgttttttcaaaggctgtttcattattggcggtatcaatggaaggtgtttcagacggtcattgattggacggtcgcgctgtatatcgttcttcccgctgccgcatttgccgtttatcaatatgctgattggctgaacggcagggggcttcttaatggagcggcaggagtattaggatggggctggctgtatgtattcagtgccctgctattgtgcacgggttttattcatacctttttgctggaagcggatcacgtatttttggtgcatgcaaaacatctgatgcaaaagctgaaacggtacgcgcttttgtattcgatgttcctttcccttatcaaatggggtgcgcttgccgtattgttatttcccttatggcgccaatacggtgactgtaccttaccggcatattcgggtatgttttgctgtctgttcggcttccatactgcaatattagcggtgcaccgacacagaaaaaacagcaggcggacattcgggaatcaggcggcaggctggctgaaagtgatggttctgatggcgggtgcgttttttatgatcgtctttgccgccgaatggtattggctttggccggcgggatgtatattgttcatctgttccgctcttttgacttggaaagggacggagacattatcggcctttgaggaagaagtgcttgaggagaacaggcgcaagctttcattcgcggcctctgttttgatgctcagccatgatgtgcagctcccgaatggtaaacataaagggcggagcaagccgtttttatatcccggctcaaagcacatctttacaaaacggtcggcgtatacggcgtggaaagaattgttctttaaagtgctgatccgaaacggcgggtatctccggcagctttaccttttaaccgcggcttttacggctcttattctcgttcttccgctcttagtgaagccggcagtcctcattttgtttgcaatcgtcagccgctatgccgcgtcacttttatttgaccggatcacggataaaccggttttaagcggtatcaagagagacagtgatgactatttcagggcgcgaaacagcgcattaaccgtcatccaagtcatctgttccgcctggtgtctcattgccgcgattctttccgttctttatatgtgaaaatccctttccgaaaaaggaaagggatttttcttaatgtccgttcaaaataaaaagctgaataaaaaacagcacggcgaagatgatgactaaaggatggatttcgcgccattttttcttagctgctttaacaagcggatatgaaatgaagccgagtgcgattccggttgaaatactggacgttaaaggcatcgccaaaatgacgagaaaggccgggaacgcttcatcaagctcattccagcggatattcgataccgcacccatcatcaggctgccgacaataatcagagccggtgacgtaatcgcggacacttccgataagacgctgacaagcgggctgaaaaacatggaaacggcaaacataaccgcaatcgtcagcgccgtcagacccgttcttccgccggccgccacacctgctgaagattcaacgaacgcggtcgtcgggctggtgccgaagatgcttcccaccgtcgtagcggtcgaatcagccaaaagcgctcttctggcattcggcagctgattgtttttgatcagtcccgcttgttcggcgacaccgatcatggtgccggtcgtgtcaaaaatcgtaacgagaagaaaagaaaacacaacggcgtacagaccgtgatgcacgacatccccgagggctccgaacggatttgtgatcaaaagcccctccggcaggtgcgggaaggacatgaatcctttcgtgaaatgaatctgaccggtcaaaaaggcaatgatagcggtcagcgccattccgatgaacagagccccgttaacattcagcaccatcagtacaatactgatgataagcccgataagcgttaaaatgacggcgggcgaatgaagatcgccgagtgcgaccagattagatttatcagccgtgatgattccggattggcgtaagccgataaaagcgataaataagccgatgccggtcgtaattccgtattttaaattgtccggaatcgcttctataagttgttttcttaaaggcgttaacgataaaataataaagatgactcccgcgataaaaacggcgctgaaagccgtctgatacgtaatgccgctgcctgtgccgacaacgtgaaaggcgagatacgcgtttaagcccatgccgggggcaatggcgatcggaaaattcgcagcgagagccatccataaagttccgacaatggaagcgataatcgtcgcggtgaacacctggtcaaacggaattcccgcattggaaaggatcaccggattgacgacaatgatatacaccattgtgaaaaaggtggtcaatcccgcggtaatttctctttttattgtcgtttgatgcttgtcgagatgaaacataagtacctccaatgacgaacattttttcaaaacatcatctatattattcgttttatcgacattttgcaagtctttatcaagaaaggggatttgtgatgaactgggaagttgaagtcatcagaaacaaagaagatctgatccgtgacacgcagaagtttttgcagatcaacagcgtaatggacgaatcaacagccggtcccggccggccgtttggagaaggcgtcaatgccagcctgacgtcactgctggaattcggtgaaaaagaaggcttcaccgtaaagaatcttgatggctatgcgggccatattgaatggggaacgggtgacgaaatcgtcggcgttttgtgccacgtcgatgtcgttccgcccggagacggctggacgagcgatccgttttcagccgatatcagggacggccggatatatgccagaggcgccatagatgataaagggccgacaatggcggcgttttatgcgctgaaaatcgtcaaagacatgcagctccctttatccaaacgcgtgagaatcatcatcggaacggatgaagaaagtgattggagatgcgtggatcactacttcaaacacgaaaaaatgcctgacatcggctttgctcctgacgcggattttccgatcattaacgcggaaaaaggaattatagatgcatcactgcgcattgtaaaaagcgcttctgacaaagacgcaaaaaatgggcttctgtcattccgttcaggactgcgcttgaacatggtgccggatgcggctgaagcggttattgaaggggacggtcttgatgccgtgcacgcatatttcagcaaatggcttgagcagtcaaaaacacaaggtgaagcaatttcggaaaatggaaaactgacgcttcgggtatacggaaaatcatgccacgcgatggaaccggataatggtgtcaatgccggcttaaagcttgctgaatgccttaacggaacagagctggatgaagccggaaagcactttgtcaaaaccgtcagtgactattttttaaatgatacacgaggcaaaaaactgaaaattgattgcagggatgacatcagcggagagcttacattgaatgtcggcacctttacatacagaaagggtgaggaaggagaactcggcatcaacatccgttatcccgtcacttcagacagcaaagtcatccgtgatgcttttacgtctgctgaagaattccggcttgaagaatttaaagacagcaaaccgcaccacgtttctgccgatcatccgctcgtaaagacgcttcaaaaggtttacgaaggacagacgggaaagaaagcggatctgatttcaatcggcggaggaacgtatgcgagatccctttcggcgggcgtcgcgttcgggccgctgttccccggccggcctgacagcgcgcatcaaaaggatgagtacattgaaatcgatgaccttctccggtcaaccgctttatacgccgaagccatttatgagcttgccaagtgataataaaaagggacgccgaaagcggcatccctttttatcattcaaatgaccataaatccgttgataaataacgttctcccgtatcggccgtcatacagatgacgatctgttcggaagggaggcgttttgcggtttcaatggcggcgaagcaggcggcgcctgaagacgggccgacgagtataccttcttcccgggccagacgacgtgttgtcgtatacgcatcttcatcagatattttcatgatttcatcgtaaacgtcctgattcagtatgccgggaataaatccggggcttgtcccgacaagcttatgagcgccgggttttccgccagacaggacgggagatcccgcgggctcggcgacatgaacaatcatatccgggaaaagctccttcagcgtttctccggttccggtaatggttccgcccgttcccgccgttgccacaaaagcaccgagcggtctgttgagctgctgaacggcctgatagatttcaatggcggtcgtttttcggtgggcatctggatttgcgccgttatcgaattgcatcgggataaaacttcccggaatctgttcggcgagttctttcgcttttttgatgcttccgggcattctttccgcccccggtgttaacacaacctccgctccgtacgctttcaggaggttgatgcgttctttcgtcatcgtgtcaggcatgacgaggattgccttgtagccgcgcgccgccgcgttcatcgccaggccgatgcctgtgttgccgcttgtcggttcgatgatgacagagccgggttttaaatgcccgctgttttccgcctcaatgatcatattgtaagccgctctgtctttgacactgccgctagggttaaacgattctaattttaaatagacctgtgctgcatgttctggctgaaggcggttgagctttacgatcggtgtgccgccgatcagctccgccgtgctgtttacgattttcaaggccggctcattcctttctgtataaaacgttcggtacataatatcctatcataatgagcggacagggttctcctctccgcttatccgttttataataacaccataaccaaagagggggagatcctcgtatgaaagcttcattgccgcattattttatcggcattccgattccggctgacattgctgaaccgatttgggaagcagccaaaaaggagccggcgttaacattcaaaaaatgggtgcacccgcatgactatcatattacactcatttttctcggagccgcggatgaagaacggcttgcgaaattatcgtctctgctcgcagatgctgcgtcggcagcgcagccgtttaccgtacagtttcagcatctggatattttcggcgaccgcagacagccgagagtgcttcaccttgagcccgaacggaatgaactgctctttgatttgcgggaaaaaacaaaacaggctgttttgaaagccggttttcaagtggaaaaacggccttatcaccctcatatgacgatggcgcggaagtgggcgggagaccggccgtttcctgacgatgtgccgtttgaaagcggcagggtgcaaagtgccgtcagccggttttccctgtttcagacccatcttgaccggtcgcctaaatacgaagaaatcgcacagtttcaattgacataaacaaatattcggagtggagaaatcacatggcacagatcatcaaaattcacgactgcatatccagatatgaacttgatccatatcattatatgaaccagtttatccggctgaagaaagaacgctttgaggcgcttcttgaagcgtttgaccggatgacggaagaaaaagaaacggaaacggctgcaggcggggaaaccgatcaagcgtcggccaggaaaaaattttccttaaaaaagagaaaagaagaaaatacggccgatataaatgaaaagaggcaccaatggtttgatgagccggagggagaagaggcgctgttcgggaatctcccgtctcgaaagtctgagctcgcgccttttttcaaagatcagctgtatgactttcaattaaaatgggcgagctccacgctttctcaaaagtctgagctttcgcaggcggtcaaaagggacaggatgttaaaaatgctggctcaaaagctgcccgattcctattttgtgatgtatcatccggttctgcaaattcagcaggcgtccgttgaactgagcatgatcatcatctcgccgctggagattttctgcgctgcttttatggaagcggaagaggacagcgtatatatcggatcaaaacaccgtttttgggaagaaagaggctccggcagcacgcgtcaagtattgaatccgtctctcagcctgcaccggacaggctcggtcgtttcgcaaatcgtaaaagaaaagcaggccgacattcccgtgcggaagcttttgctcagcagaacgtcttatattgattacccggagccgccgtacgggctggaaatagctgataaacggactgccgcagagtggctggaaaagcagcagaaaaatacggcgccgatcaagcaccaccagctgaaggcggcgaaggctcttttgtcttacggcttgagcgattcaagccggagacaggaatggcttgattaaaacggatgtttgccggctgtctcttcatctatgaagcaggtgaaaacaaacgatgagtcaatggttttttattattaatccggtctcaggaggcgggcggagccggcgtgtctggaaatcagttcaaaaagagctgaccaggcgcggggtcagccaccgctcttttttgaccgggcatcccggacatgcggaggtgctggcgaggcagatttcaatgatgcaggatcataagcttaagcggctgttcgtcatcggcggtgacgggacgatgcatgaagtcattaacggactgaaaggaacggatcagattgagctgacctttgtgcccgccggttcgtacaatgacttttccaaagggctcggtattaagaagtcggcgctcctccaagaaatcaaaagtctgcaccgcccgctcacacggaaattttttgcgggaaacatcaacttttttcatgacaaagcgcaatcactttattttattaaccacctgtctgtcggcttcgatgcctcagttttgaaggcagcggcgaattttccgttatcgcgcgttcttcggtttttgcgtctcggttttgtgatttacccgctcgcgcatttacatacggcctcggggtttcagccgttcagatttgtttgcacggcagacggccagaggcgagaattccgcaatgtctggtttgtcatagcggctaatcacccttattacggaggcggcatgaaagcggcgccttcagcaaatccccgtcaaaaccattttgatattgtcatcgcagaaaacctgtcctttttctcgctgtatcgttttttatgggcgatgagcttcggccggcatatcaaaatggacggagtgacgatgataaaggggaaggaattcgtttttgaaacagatgggaaaattccgtttcacgctgacggcgagctgatcggaacgacgccgtttcggcttatgccgggcggtgcgctgttgaaaataaaaacataataaacaaatgaaacccgtcaaatgtttcacggcaaagagcggttcgcggcataaatcttcagaattcacaggtgttcttgctagttttgcttgacgaagtttgtgctgtagcgctaaaatttataggacggctattgattagcatatgagactctcaatagctgtcttttttattctcatgaaattgtttatgacaggccgctccgccaatagagaaaggctggaggcctattctaaaatattttaagaaatgatgggttgaacattgatatgaactggttgggacaattactaggtagcgattgggagatcttccccgccggaggagctacaggagatgcatattatgcgaaacataacggccaacagctttttttaaaacgtaatagctcgccctttttagccgtgttatccgccgaaggcattgttccgaagctggtttggacaaaacggatggaaaacggagacgtcattacggctcagcattggatggcgggcagggagctgaaggcaaaggatatgagcggacgcccggtggctgagctgctccgcaaaatccacacatcaaaagctttgctcgacatgctgaaaagattgggaaaagaaccgcttgatccgggcgcccttttgtcgcagctgaagcaggccgtctttgccgtgcggcaattttcgccgcttattcaggaaggccttgcttatttggaagctcatgtggatcaggtgcaattcggtgaaaaagtcgtttgccattgtgatgtgaatcataataactggcttctgtctgaagacaaccagctgtatttaatagattgggacggcgccatgatagctgatccggccatggatctcggccctttattgtatcattacgtcgaagagccagcgtgggacagctggcttgggatgtacggcatgaagctcacggaagggcttcggctgaggatggcgtggtacatgttatcggagaccatcaccttcatcgcctggcacaaatcaaaaggaaacgacaaagcgtatcatgatgccatggaagagcttcatgccctgatgaagcggattgtcaagtagtcaggagtacgaatccatctgctccacccattgggacaaatggttttggtgctcctgaatatgcgtgtcgatggaatcggccgtgatgccggactggctgtagcggtagacatcctcgagcacgttttttatatttgaatcaagcccggtgttggccatcagtgatttgatgacgcgctccagctgttcatactcggcaaccgtgccgcagcaatccaattgatggtcggccaatatgtcctttaataaccggacctgatgttcgcttgttaagcccatgattcatatacacatcctttctgtgtcatacattgtgcaaagcggtgcggttttatgcatcacatgagtgttccggaccggggagcctctttttttatgcagccggcgcctttaaaaggcgcttgcggctctttatgtttcatggtatgttgttactcgaaattatagatagaggtgtcaatcatatgagaatgcgccataaaccttgggcgaatgattttctggcagaaaacgctgacatcgccatcagtgatccggcccagtataaagggcgatggaacacggtctttggcaatgacaacccgatccacattgaagtcggtacgggaaaagggcagttcatttcaggaatggccaagcagaatccggatatcaactatatcggcattgagctgtttaaaagcgtcatcgtcactgccgtccaaaaagtcaaggacagcggggctcacaatgtccgtttgttaaatatagacgcggaaacactgaatgacgtatttgaacggggagaaatcaagcgcgtatatctaaacttttctgacccgtggccgaaaaaccgccacgaaaagcgccgtttaacatttaaaacgttcttgaaaaaatacgaagaagtgatgggcgaaacaggtgagattcattttaaaaccgataaccgcggtttattcgaatactctctgaaaagcttttccgaatacggcctgcttctgacggaagtcagccttgatctgcacaacagcgatccgaagggcaatattatgacagaatacgaagaaaaattctccgcgctcggccagccgatttaccgggccgaagttgaatggagaacaaaaggcagactctgatgcgggagtctgtttttttatgccgccatttgctaccattacatcaggagggatcaagatggagacattgaatattgggaatatttcattaacatggctggacggcggtgtgacgcatatggacggcggagcgatgttcggcgttgttccgaaacctttatggtcgagaaaataccccgtaaatgacaaaaaccagattgaattaagaacagacccgattctgatcagaaaaaacggcctgaatatattggttgacgcgggaatcggccgagggaaattctctgataaacaaaaaaggaattacggcgtaacacaggaatccaatctgaaacaatctcttcgtgacctcgggctttcttgtgaggacattcatattgccgcgatgacccatcttcattttgaccatgcatgcggcctgacggagtacagcggagaggagcttgtctctgttttcccgaatgcccgcattatcacttctgcaacagagtggcgcgaaatgagaaaccctaatatcagatcgaaaaatacatattggagagaaaattgggaggcggtacaagatcaggtcgaaacctttgaaaacgagtatcagctgacagaaggcattacgatgcaccacaccggcggccacagcgacggccacagcgtcatcgtcttagaagacggtggggaggcggctgtgcattttgccgacctgatgccgacgaatgcgcataaaaatccgttatgggtgctggcctatgatgattatccgatgacctctattccagaaaagcagaaatggcagacgttcgcggcagaaaaagacgcctggctgattttctatcacgacgcgatttacagagcggtaaaatggggagaagacggcgaagtggctgcatctgtcaaacgggagagaaaataagcggatcgatgatttgcctgtatgaatttcgggaataaaagcaaacctaagacaaattgctttgaaaggaagagacaggtgaatcaatttcaagtgaccaaagatggagaaatcaaaacaactctgcgcggattagaagtgctttctacgccttttttaaataaaggggtggcctttacacaggaggaaagaaaggaactcgggctcgaggggtttctgccgccgaaagtattgacaatcgaagagcaggcgaggcgtgcctacgaacaattcagttcgcagcctgatgagctgagcaaaaatgtgtacttgaccgctctccatgatcggaatgaaacgttattttacaggctgttaaatgatcatttaggcgaaatgctgccgatcgtatatacgccgaccgtcggcactgcgatccagcgttacagccatgagtacagaaaaccccgcggtctgtatttgtcaatagatgaccctgaaggaatgcgcgccgcatttcagcagttcggaaaaaatgaaaacattgacttaatcgttgcgacagatgccgagggcattctgggaatcggtgactggggcgtcggcggcatcgccatttctgtcggaaaacttgcggtgtatacggcggcggcaggaattgatccgtcacgagtgcttgcggtcgtattggacgcggggacaaatcaggaaagcctcttaaatgacccgctgtatgtcggaaaccagcattcaagagtgcgcggcgagaaatatgaccgctttattgatgagtatgtctcgcttgcccgggaaacattcccgaatgcgctgcttcattgggaggatttcggtacggctaacgcccgcggcatattaaaacggtataaagataaagtctgtacgtttaacgatgacattcaaggaacgggcgcggtatcgcttgcagctgttttagcgtgtgcaaaagcatcaaaagtgcctttaaaagagcataaagtcgtcgtcttcggcgcgggaacggccggtatcggaattgctgagcagctgcgcgaagccatggtgcatgacggattaagcgaagaagaatcctacagccatttttggtgtatcgacagaaacggattgttaacggatgatatgaaggacttgcgtgattttcaggttccgtacgcgcgccctgctgatgaagtaaaagagtacggccgcagcggtgaaggcggatcaattgatctggcggagacggtgcgtcaggccaagccgacgattctgatcggcacatccaccgtatcaggcgcatttacggaagaaatcgtcaaagaaatggcctcgcatgtcaaacggcccgctattttgccgatgtcaaacccgacgacattatcagaagcaaaacctgaagatttgattaaatggacggaaggccgcgcgcttgtcactacgggtagtccgtttccgcctgttgcgtataacggcgttacctaccatatcggacaggcgaacaacgcgctcgtattcccgggactcggactcggcacgattgtgacaaaagcaaggctcattacggacaatatgttcgttgcctgcgcgaatgccatcgccggtatggtggacgtcggcaagccgggggcgccgatgcttccaaaagtggaggatctcaggacggtatcggcaactgtggcggtagctgtagcaaaagctgcgattcaggacggtgtagcggaaacggaacccgaggatctgatccaagcggtgcaggacgcgatgtggcaccccgtatataaacgaattcggccgatgtaaccgaataaagcccaaaacgctgatggttttgggctttattttttgcttgtccgaattatgaggcgacagaatcaatgacatcgacaatctggcctgtttttgcattgaccataacttcatattgctccagttcgccgaatgccgaacgtgtcacgccggtcttgtatacctggatggtttctccgtttacctggtagggctccggctctgtgtaaatccatgatccgtctatcggcccgcgctgtttaaaagccgctttcacgatacggagcgctttttctgaagagatataaggtttcatcgcatactttttcactgcgatggcagcgcataatccgactcctgcacctaagagaaaatgacgtaatttcaatatgaagcacctccaattatgtcgtagtttttattatacagaagatgccagacggtgttaagtaaagcgtcggttttccagcccattcaatctgagcgcttggaaaacggttgtttttctaataaaataaaagcattacatagaaatgaggggaaaatatgaatgaggaaacgaaaacgcttttccggacgctgacgcagcttcccggtgcaccgggaaatgaacatcaggtccgctcctttatgaaacgggagcttgcgaaatatgcggatgacatcgtgcaggacagactcggaagtgttttcggagtaaggcgcggcgctgaagatgcgccgaccgttatggtagccggccatatggacgaagtcgggtttatggtaacgcagattacggataacggcatgctgagatttcagacgctcggcggctggtggagtcaggtgctgcttgcccagcgcgtcgaggtgcagacggataacggaccgattatcggcgtcatctcaagcatcccgccccacattttaacggatgcccagcgcgcaaagccgatggagatcaaaaatatgatgattgatatcggtgccgatgacagagaggacgcggtcaaaatggggatcagaccgggacagcaggtcgtgcctgtctgcccgttcaccccgatggccaacgagaagaaaatattgtccaaagcgtgggataaccgctacggctgcgggttaagcattgaactattaaaagagctgcacggaaaagacctgccgaacaatctgtacgccggggccaccgttcaggaggaagtcggcttgagaggggcgcagacagcggccaacatgattcagcctgatctctttttcgcgcttgatgccagcccggcaaatgatatgagcggcgataaggagctgttcggccgtctcggcgagggggtgctgctccgcattctcgacagaacgacggtcatgcaccgcgggatgagagagttcgtccttgatatggcggaaacgcacaatatcccttatcaatatttcgcttcaggcgggggaacggatgccggacgggtccacatatcaaacagcggggttccgtctgccgtcatcggcatttgttcaagatacattcatacaaatgccgccatcatccatgtcgatgattatgccgcggcgaaagaaatgctcattaagctggtcatggcgagtgacaaacagacggtcgaaacgatcagagaaaatgtgtaaaaaaataagcaggaccgcataaaggcggcctgcttattctgtttcaaataaataagagagtgctttcatcgcttgattgacggtttcgaccgtgatattcgcttttccggaaagctctttcagcggatgatgaagttctttcggacggatgagaatgagcggctttccttttgcgatggcataagaagcatccatcgcggtattccactgcttatatttctcgccaaacagggcgatcacaaaatcggctttttccatcagcacctctgtacggaaattgttgatatcagaagctctggcgtcttttaaaacagaatcgggctgcacgcccataatctcttctccgatattgtctgagcgttcatggttttccatcgggccgacaaacgtaatcggcaggtccagcgctgttgctttttgtttgatctcgtcccgccaatcactgtggatttcacccgctaaatacacgacaaactgcatcttttgcccctccttatgtacatattcatattttcgtacggctacaagcaaaatggtaaacgaaacttgcttgataatgcaaatgaaatatgataatgatattgcatatagttggtcttgccgtaaacagtctggtatgatccaattggacaaacatcagcatataaaaaactcataatccagatggaggaatgacaatgaaaaagattgaaagcacggaagaattgcaaaaagcggtacaagacgattgggcggtatttatgttttcagcggattggtgcccggactgccgctttgtggagccgtttctccctgagctggaagcggactttcctgaattcacttattactacgtagaccgcgatcaatttattgatacatgcgcagaatgggaaatttacggcattccgagctttgttgtgtttaacggaggaaaagaagtgaaccgcttcgtcagcaaagaccgtaaaacaaaagaagaaattgagcaatttttaaccgattcccttgctaaagcataaaggaggccacgggctttgaaaatgacgtcaaggaagctggcggatttattaaaacagcgcctgcagcacgagaaccgatccttcttttttgacagagaaaaagacaccctccgtgttgaggatcaaacgaccaaaaaaggcatcacattggagctcccgccgatcattgcgaagtgggagacgaaaaaagaagaagcgatcgacgaaatcgtctactatgtgtcagaagcgatggaggcgatggaaggaagcggacaggagatgtccggaaaggaagccggaatctatccggtcatccgctccacatcatttcccgatcaaacgagtgacggcattccgctcgtgtatgatgaccatacggccgaaacgagaatctactacgcgcttgacctcggcaagacgtaccgcttaattgacagccgtatgctcgagaaagaaaactggacaaaagaacggatcagggagacggcgtcattcaatctccgctctcttccttcggtcgtgaaacaggatacggttgcggataattatttttattttttcagggcgaatgacggctatgacgccagccggattctcaatgattcgattcttcatgaatacaagcaggccgctgaaggcgaattagcgatttccgttccgcatcaggatgtattaatacttgctgacattcgaaatgaatcgggttatgatattttagggcaaatgtccatgagcttctttgcaagcggcaaggtgccgattacggccctttcatttctgtataatgaaggcagactggaacctgtgtttatcatggcgaaaagccggccgaaaaaggattagaaaggatttttcttatgaacgctttttacaataaagaaggtgtgggagatacgcttctgatctctcttaaagatgcagcacgcgaagaaatcggctatgaaagagaaggcgatgtcgtcagaatctttaacaaagaaacaaaagaaacgacgggctttaacatttttaacgtgtcttcttacttacagattgaggacaacggccccgtcgctttgtctgagacattcgtacaggatgtgaatgaaatactgaacagaaacggcgtttcagaaacgctgacggttgacctttctccgaaatttgttgtcggtcacgttgaatcgaaagaaaaacatccgaatgcggataaactgaatatctgccaagtgaatgtcggagaggaaaccctccaaatcgtttgcggcgcgccgaacgtggacaaagggcaaaaagtcgtcgtcgctaaagtcggcgcggtgatgccgagcggacttgtgattaaagacgctgaattaagaggcgttccgtcaagcggcatgatctgctccgcgaaagaactcgctttgccggatgcgccggcggaaaaagggattcttgttcttgaagacagccgcgaggccggcgaagcatttcaattctaactcccataaataagcgcacagaatcgaatgatgtgagagaaagccgttaagcaggcctgcttaacggctttcttcagttgggagcttaatcttttctgagccgcccggcaatggtatactaaatatcgtcccagactactaaaaagggagttagagagtgattaaacatgagttggctgaataaattttttgacttatttttaggtgaaaaagaagaagagcatgaacatgaaccaaacacgcatgcccaaatcccgaaacagcagataccggatcagccagaaggcaaattcacgcgcatggaagatcctaaaatatattacgaatatccgaaagggaatttccgcttccccgtcgttccggacggctataagcgaacggagcaaaaccaaagacagcgggaaaggcacgaacgccgccagccgtcccgggattatgccgccgggaaggagcaaaccgagcggaaacagcatacacataaagagcctgaaacggtgaaaaagccctttaaaccgtcatccattccttcaccggtttacggctttcaatctcagcacagcataaaaaaagcgcctatatccgaaaagcggcgtgaagagaacgtaacattgctgtcagaggagcaatttgttccgctaaaagccggtcaggaaacagaaaaagagcccgtcttcacaacatacggcataacaaaacagacgaatgaccggccagaaccgtttgcgaaacaagaaacggaagaaatcccggccgttaaaaaagaggagcttcacaccgaggctgagaatgcaaaagagcaagtgtttgcagcagcagaaccgcagcagactgaagagcgggagcacacggaaagcgcggagtctgccggctttacagaagaacaagagcatgaacaaacccgcccgcagcctattaaagagcctgagtatgaagcatcccgaacggctgacaacacagaggaacaagctgcgccgcaggaggaatatcaggagcctgagccggaaaaagcaccgccttttgaaaccgcggaagaaccggtgtatacatacacagaacccggatacgaagaggaagttcagccgcaggctgaagacaagcccgaatcagctgaaaccgacgcgaaacaggaagcagactctcagcctgagtacaatgaagtcacgcggcattcagaccccgagcctgaacctgcaagcatcgagacggccgatgccccgtcccggcctgccgaagaaaaaacggagcatcacggacagcctcagcctgtgaaaaaagcggagcggccgaaagagcgcaatgttccgtttaacgtcatgatgcttaaaagcgataaacacaagcaggcgaagacgccagagggcggagcgagctatgtctttccgaatctgtcgcttctggacgtaccgccggcgcaaagacatgacgaccaatcgtggattgaagaacagcgcgagcttttaaacgttacactgaaaaactttaatgtgcgcgcccaagtcgttcatgtcacacaaggcccgtccgtcacacgttttgaagtgcatcctgagcccggagtgaaagtaaacaaaattacaaacttagcagatgatattaaactgagcctgtctgccaaggatattcggattgaggcgccgatccccggtaaaaacacgatcggcattgaagttccgaaccgcgtaagcaaagtcgtcgatttaaggcagatgatcagaagcgccgctttcaggacgaatccgtctccgcttacagccgcgctcggtgtcgatatttccggaaacccggtcgtcattgatttgaaaaagatgccgcacgggttgatagcgggtgcgacaggatcgggaaaaagcgtctgcatcaataccattttggtcagtctgctttataaggcggatccgagtgatgtcaaaatgcttctgattgatccgaaaatggtcgagcttgcgccttataaccaaattccgcatttggtcagccccgtcatcacggacgccaaagccgcgaccgccgcgttaaaatgggttgtggaagagatggaacggcgatatgaactgtttgcccattcgggtgtgagagatatcggccgctttaatgaattaaccgccgatcataagacaggcgaaaagcttccgtacctcgtagtggtcattgatgagcttgctgatttaatgatggtcgcgccgaacgatgtggaagaaagcattgccagaatcgcgcagaaagcgagagcctgcggcattcatctgcttgtcgcgacacagcgtccgtctgtcgatgtcattaccggaatgatcaaggcaaacataccgacgaggattgcattctccgtctcaagccaggtagattccagaacgatcatcgacatggcgggagcggaaaagctgctcggaaaaggcgacatgctgtactgggaaaacggtaccggaaaaccggtgcgcctgcagggcaactttgtatccgacagagaaattgaccgcgtcgtctctcatgtcagaaagcagctgccgccttcttatttgtttgaacaggaagaactgatcaggcagggaaccgccctcaaggaagaagacgaactgtttcctgaggcgtgccaattcgtcgtggagcaaaacagcgccagcacctcaagccttcaaagaaggttcagaatcggttataatcgcgccgcgaggctgattgacatgatggaagccgaaggcatgatctcagaagcgaagggcagcaaaccccgtgaagtgctgattacggccgctgacattgctcaagaataagaatatcgttcatttttctcacaaacatggtatgatagtggatggaccatcaaaactgcatcactgtcacgcgctgaaatatcatgcggcaggtttaatcaaaaagaaagttacagatactgacgataacgtaaaaataaatggaagcgccgctgtgcgggcttttcgcccgcggcggtcgcaaaatgaaatgagcgtcatatactggggaacagatagacgtttgttggaggtacgattatgactgtttatcattttgttggaataaaagggacaggtatgagcccgcttgctcaaatcctgcatgatacagggtatcaggtgcagggatcggatatcgagaagcagattttcactcaggctgcccttgaaaaaagaaatatcccgatctatccgttcagcgccgataacatcaaacccggcttaacggtaatcgccggaaacgcattccctgattctcatccggaaatcgcaaaggcgctcgctgaagggattcctgtcatcagatatcataaatttttagctgaatatatgaaaaaatacacaagtgtcgcggtaacgggcgcacacggcaagacgtccacaacgggcctcttggcacacgtgatgcagcaggcgaagccgacttcgtttcttatcggggacggaacgggcagaggaaatgaaagcagcgaatactttgtatttgaagcctgcgagtaccgccgtcatttcttaagctatcagcctgattatgcgattatgacgaatattgattttgaccaccctgattatttcgccaacattgacgatgtgtttgatgctttccaaaacatggcgcttcaagtcaacaaaggcatcattgcctgcggtgatgacgagtacctgccgaaaattcacgccaatgtgcctgtcgtttattacggcacgggagaagaaaatgattttcaagcgagaaacatcgtgaaaaatacggaaggcacgacatttgacgtctttgtccgcaatacgttttacgatacgttctacatcccggcatacgggcatcacaatgtcctcaattccttagcggttattgcgctctgccactatgaagagatagacgtgaacatgattaagcgcggacttgaatcattcggcggcgtcaaacgcagattcaatgaaaaagtgatcggcagccaggtactgatcgacgactacgcccaccatccgactgaaatcaaagtcacgattgaggcggcgcgccaaaaatatcccgaacgtgaaattatcgcggtatttcagccgcatacgtttacacggacgcaatcattccttgatgaattcgcagaaagtttaagcgcggccgatcgcgtgtatctgtgtgacattttcggctcagcccgcgagaacgtcggcaagctcacgatcacggatcttcaggaaaaaatcgataacgcagaactcattgaagaaaatgacacatccgtgttaaaagcgcatgaaggcgcagtgctgatcttcatgggcgccggagacattcaaaaatatatgagagcctatgaaaacgtcatagcgtaacgaaaaagcagtggggctctcactgcttttttgcgcgtgctgcaaagggatttaccgagaaacggagaaatagtatacatacagatctttcatatatgtttatcattttaagaattgggtatataccactatatcctgcattaaggaggtattagatgatcatcattctttacttaagtgtcgcactcattgccgttgcatttctcatcctcgtcatctatctgtccaaaacattaaagtccgtgcagatgactttaacaaacgttgcctcgactttagacggccttgaagggcagatgaaaggtattaccgcagagacaaccgagctgttacataagacaaaccgtctcgcggaagacattcaggaaaaatcagagaaattaaatacggttgtccatgctgtccaggaagtgggaacttccgtccagcagtttaatacatccataaagcaggcagcaggttccgttacggcctctgtaagagagaatcaggataagatcagtcaggttgtcacctggagccaggccgctatggaaatatgggacaagtggaagcaaaagaaaaaaacatcgctttaatcataagaaaaatccactaaggaggaatcataatgagcaaagatggaatcaatagtaaggattttttaatcggaacgctgatcgggggaattatcggcgcgacaacggcgttgtttctggcgcctaaatcaggtaaggagctgcgcgacgatctcggcagtcaggcttctgcgttaaaggataagacggacagaatgacggccgacgcgaaagaaaaaggctctcaatatgtcagcatcgccaaggacaaaacatctaatatcacccagctggtagctgatcagtcaggccagattatgaataaagtgaaggatttaaaagaccgttctaagagcacactaaccgagaaagccgaagagacgagaagcgaaatgcaggacacggcccaaagcatcaaggccgaagcggaagacgccggggaaaaagccggtcaggcaaatcgctgatcttcaataaggagagataaccgacatgacaaaacagctgatatcgtctgaagaagagttcaaaaatgccgctgagaaagaaaacacgctcgtgtttttgaaacacagcacaacctgcccgatcagccaagccgcgtttcaggagtttgacgcctttgcatcggcgcattcggaagtgccttcttattacctgcaggtgcaggacagccggccgctttcaaactatatcgccgagacatacggcgtgaaacatgaaagcccgcaagtattcgtcattgcaaacggcgaagtgaaatggcacgcgtctcattcacaaatcacaaaaaacgcaatagagcagcacctttcataattgctggccgccggttgataccggcggtttttttttttgaaaaaaactattgatcatttcagccggatcatgtaggatatcaatatatactgcttcaacgcataaaagcttaaaagcgttttggtgataaagccgaatgtgaaaaaatttattatttcatattcctattttcgcataactgtagtaagatgcatgttaaccattaaaataaaacatagcatagaagggatgaaaaagatgagcaacaaggaattagagagcctaagacagcaggcagacgcactaaacttagaaatccttaaattaatcaatgaacgcggagccgttgtaaaagaaatcggtaaagcaaaggaagcacagggtgtcaaccgatttgaccctgtcagagagcgtacaatgcttaaccgcataattgaaagcaatgacggcccatttgaaaactcaacgatccagcatattttcaaagaaattttcaaagccggacttgaacttcaagaagaggatcacagcaaagcgttgctcgtctcccggaagaaaaaagcagaagatacgatcgttgatattaaaggtgaaaaaatcggtgacggcgatcagagattcatcgtcggaccttgtgccgtcgaaagctatgagcaggttgccgaagtcgcggccgcagcgaaaaaacaaggcattaaaatcctgcgcgggggcgcgtttaaaccccgcacaagtccgtatgatttccaaggtctcggcgtagaaggcctgcaaattctcaaacgcgtcgctgatgaatatgacctcgcagtgatcagtgaaatcgtaacgcccgcccacattgagcaagcgattgattacattgacgtcattcagatcggcgcgcggaacatgcaaaactttgaattgctgaaagccgccggttccgttaaaaagccggtattgttaaaacgcggtcttgctgcaacaatttcagagttcatcaatgcagctgaatacatcatgtcacaaggaaacgaccagatcatactttgtgagcgcggaatcagaacgtacgaaacggcaacgagaaacacactcgacatttctgccgtgccgattttgaaacaggaaactcacttgccggtgtttgttgacgtcacacactcaacaggccgccgcgatctcctgcttccgacagcaaaagcggcgcttgcgatcggcgctgacggcgtgatggccgaagttcaccctgatccttccgttgccctttcagactctgcgcagcagatggatatacctgaattcgagaaatggctgaacgaattaaagccaatgctgaaagtaaaagcataatacaacgttccgctctttaaaggccgccacgcgcggcttttttttcgtatcttcattttatttaattataaaatgaaagtgaacgttttcatcactgggaaaaacgtgtataatttcatgagagatatttaaatttgatgaataatgaaaaataatgtacactactgacttacgcttacaatcataaacgacagaatgcgaaatcgtacgacatttctttacataaagtgtttatgctatagataaggataagtgtatccagtaaaaggagtggtttcagtgagcaacattacgatatacgatgtggccagagaagcaaatgtcagtatggcgactgtttcccgcgtcgtgaacggcaacccgaatgtaaaaccgacgaccagaaaaaaagtattggaagccattgatcggctcggctatcgcccgaatgcggtggcaagagggcttgcaagcaaaaaaacgactacggtcggcgtcatcatccctgatatctcaagcattttctactctgaacttgcgcgtggaattgaagatatcgcgacgatgtacaaatataatattattttaagcaactcggaccaaaatcttgagaaagaactgcatctgttaaatacgatgcttggcaaacaagtggacggtatcgtatttatgggcggcaacattacggacgagcatgtcgaagaatttaagcgctctcctgtgccgatcgtcttggcggcatcagtggaagaacagggcgagacgccttctgtcgccattgattatgaacaggcgatttatgatgccgttaagcttttcattgataaagggcatcgcgatattgcactcgtctccggaccgatgcaagagccgatcaaccgttcgaaaaaactgcaagggtacaaacgggcgcttgaagaagcggcgattccgtttaacgagcaattcgtagcggaaggcgattacacctatgattccggtatggaggcgcttcaaagcttgatgggccttgaccggaaaccgacggcgattctttctgcgacggatgaaatggccctcggcattatccatgcggcccaagatcaaggtctttcgattcctgatgatcttgatattatcggttttgacaatacgagattgagcctgatggtccgccctcagctttcaacagtcgtgcagcctacgtacgatatcggcgccgtggcgatgagacttttgacaaaactgatgaacaaagagccggttgaagagcatatcgtcgaattgcctcaccgcatcgaattaagacaatcaaccaagtcataaaaaaacggaaaagcaagcttcactctgaggggtggaatcttgcttttttacttgagtaaggagaagatatgaaacgttttgattatctgacgcccgttggctttatgttaggctgtattattgtcgcaatcggtattctgtcagggacgggactggcgggaatcagttcatttttagatctgacttcttttttaatcgtcacaggcggccttgctgcggcgatctttatcagctttccgccgagggatttaaagaaaaccccttctgttctgaaacaggtattctcccgtcaggatgacaatgtgaaagagcttgtcagagtatttgtcagcctttcggagcaggcgcgcaggcaggggctgctgtctctggatgaccaggcgcgtgagatcaaggatccgttttttaaaaaagggcttttgcttgcgattgacggctgggacgaggaaacgatccggctggtgatggattctgagatcgccgcgatggaagaaagacacagaaaaggaagacgcgtttttgaaaaagccggtgatttcgcacccgcctggggaatgatcgggacgctcgtcggactcgttctcatgctcaaaaacttaaatgacccgcataccctcggaccgaacatggctgttgcgctattgacgacgctgtacggagcgctgcttgccaacttggtgtttatcccaatcgcggcaaagcttgaagaaaaaacggaaagtgaaattttcatcaaacaggtcatgatcgaaggggttgtcggcatccaatcgggcaaaaatccccgcaacctcgaaagtcagctcgtcgtcttcagctcaagagaagactggcgtaaaggacagcctgcgaacaagaaaaagggcgctgtccatgaagcttagaaaagagcgttttgaaagaagaaacaaaccggaacattccggcggttcaccgagatggatggtgacgttcgctgacttgatcacgctcattctcgtgttctttatattgcttttttcgatgtcgcaaatagacgcggaaaaatttcaatctgccgtttcatcgattcatacaaacggcagcgggggtgaaccggcgtcatcagacaaagcaaacgaaaataaagaacaggatttgctgttacaaaacgtgaagacatacataaaagcgcatcatttgagttcgaaattgacggcgaagcgcgatgagcgcggagtggttctggtgctgcaggaggccgttctgtttcagacgggaaaagcggatgtgctgaaaaacgccgagccggttctgcatcagatcgcggtgcttttaaaaacaattccgaatgacatacaggtagaaggccatacggacagccgccggatttccacctatcaatttccgtcaaattgggagctgtcgtctgcaagagcggcgagtgtgatccggtattttaccgcgaatgaagacttttccgccaaacggtttatctctgccgggtatgcggatacgaaacctgtgaaggacaacaaaagtcccggacatatgaaagaaaaccgccgtgtagaaattgtgatcaaaaaaacgacctcctcataaggtcgttttttatttagtcttataccgctgctcagaccggatggcaaaaagtgctttttccacggtttgggcatttttttctgaaatttcttctttgcggggaatcggaggatataattgttcaggatcactccaaaaagcgggcaacgtgcagggggagtgcttctgccatttatcaatccatttctgcggtatgcgctccccgggatcaatccctttcatctcaagccaaatgcggctccatgctctcgggacgactctccaaatatcgtatcctccgccgccgaccgcgatccatctgccgctgcaatattgatgggctaatgaatgagcgagccgcgggatctcctgataaatggagattgtattggacaggtgtgtcaatgggtcgtaataatgggcgtccgcaccgttttgggtaagaatcacatccggcttgaaaaaagccgcgatttctgaggcggccgtattgtaagcgtgaagaaaggaatcgtcctctgtgaaagcgtccagcggaatgttaaaagaatagccgtagccttgcccgcttcctttttccagtacctgtcccgtcccgggaaataaataacgcccggtctcgtgaaaagaaacagtgcagacatcagacctgtcgtaaaacgtaaattgaacgccgtcgccgtgatgagcgtctgtatcaatgtataacacttttgccccgtagttcttctggatgtattggatggccacggcgctgtcattatagatacaaaagcctgaggccctgccgcggaagccgtggtgaaggccgcctcctaaattgcaggcgtgccttgcttgtcccgtcatgacataatcagccgccgttaaggtgccgcccaccagaagtgacgcggcttcatgcatgccggcaaaaacgggggtgtcttccgttccgagaccgtagctttctccttctgcggcagggagccggcccgcacccgctagttccaccgcctgtatataatcctccgtatgaacgagagccagctcttctttagcggccgcgcgcggtgtgacgatatctccttcgtcaaacgcatccgccgcctgaagcagatcgtatgttaaaagcacacgacgctgattgaacggatgttcctgatgaaattgatacgtctgataagaaggcgagtaaacaaaaacgctgtctctcatggctgatccctcaaatgtttcggccataagacattgtatccggcttcttgaacggcacggataaaagggagcggattcatcgtcttcacccggaagacgagaatgttcgacccggcggactcatggggatagacgagcacactcaggatttgcagctgaagatcacggcacatgcagctgagatcagcaaggctttttgtcatatccgtcaccaggatttccacctgtgatcccggctgggccgcgcctgtcaggctgacgaaagtccggagcacgtcggttttcgttaaaatgcccgtcagcttatggtttaccgtaatcggcagacagccgatgccgtgctcataaaaggaagcggatatttcttccacaaagtcaagcggatgggcgcagatgacattgcgcttcataatggtctccactttgtttgtcagaaacgcgccgcgttccttttgttcaaagctgccggggccggcctgtttaatgtctctgtctgtgacaataccgatgacgtgcagctcgtcgtcgatgacagggagatggcggatatgatatatcttcattttacggacggctgtttcaatggagtcgtgttttgagacggtgatgacgtcccgtttcatgatttgttctgcaatcatctttttatcccctttgtatgtcagtcaatacataaatcgctgataaaaacgaagcctgtcgaactgttcaattgactcctgactgacgtgcctgccgatgcgggccatcagacaattggccggatgagagctgatttccggttcatccgttgcgaaccagacaagacccccggcattcatcatcttttccatgatctttctgtattcccacacatcttttttcattccttttaaatcccaatgccagtaatattccgtcgtcatgatgatgtaccgttccatctgttcatccatcatgctgactgtcagcaaagtttttccgacagaacagcccctgtagccgggagcgacctcgatcgccccgagttcaaggaggtcttccatatttccgtcagaccatcgttcaagcggatcaggatataaatacgtcacatagccgataatcgtctgtccgtccctggcaataatgatccgaccttcaggaagcccggcgatctcgattaacgctttgtgctgttcatgaggaaggcgaaaggctgtcaggccttcatgaaactcatactgtgctagatcccctggaggaacgggcccttctactaaaagagggccggctgctgtctgaattgatgaagaatggtacgttttatgatgtttcactgattcaccgcctgtcggttcttaataaaaacacatctcttttaagcataacaaaatataaagcgttttcaatagtgttgtaatttatattttaaaaattgagaaaactgtgaacatctactataattagtctatagataagcaaagggggatgttgcatgaatttgaaagcgttgccggcggaaaaggggaattatcatctgcgaaattatgaggaaacgtaccgcagcttcgattggaaagaggtcgaagcggcattttcctggcatcagacggggaagctgaatgcggcgtacgaagcgattgaccgtcatgccgaatcatttcgaaaaaacaaagtagcgctatattacaaggacgcaaaccgggatgaaaaatacacatttaaagaaatgatggaggaatcgaaccgggcgggaaatgtactgagacggtatggaaacgtggaaaaaggggaccgcgtttttattttcatgccgcgttcgccggagctttactttatcatgctcggcgcaattaaaatcggtgcgatcgccggtcctttatttgaagcgtttatggaaggcgccgtcaaagaccgcctcttgaacagccaggcaaaggttgtcgtgacaacacctgaactggccgaacggattccggcggacagcctgcccgacctcgagcatattttcattgtcggcggcagcaaagaagcgggagataaaatcattcattatgataaagcggctgagggagaaagcacgagacttgatatcgaatggatggacagaagagacggctacctgcttcactacacatcaggatctaccggaacgcctaaaggtgtgctccacgttcatgaagccatgattcagcaataccagaccggcaagtgggtgcttgatcttaaagaagacgatatttactggtgcactgcggacccgggctgggtgaccgggacggtgtacgggatatttgcgccgtggctgaacggagcggcgaatgtgatcatcggcggcaggttcagtccggaaaactggtacggcacgatcgagaagctcggtgtcagcgtctggtacagcgctccgacggctttcagaatgcttatgggcgccggagatgaaatggcatccaaatttgaccttacttcacttcgtcacgtcctgagtgtcggagaacctttgaaccccgaggtcatcaagtggggacataaagtattcggcaagcgcatccacgacacgtggtggatgacagaaacgggcggacagctcatttgcaattatccttgcatggagatcaagccgggttcaatggggaaaccgattccgggagtggaagcggcgatcgttgacaatcagggaaatgagcttccgccgtaccgaatgggaaatctcgccattaaaaagggctggccgtcgatgatggattccatttggaacaataaagagaaatatgattcttatttcatgccgggcggctggtatgtttccggagattctgcttatatggatgaagacggttatttctggttccaaggcagagtcgatgatgtcatcatgacatccggcgagcgcgtcggcccgtttgaagtcgaaagcaaacttgttgaacatccggcgattgccgaagccggcgtcatcggaaagccggaccctgtccggggagaaattattaaagcgtttatcgcgctcagagaagggcatgagccatccgatcagctgaaggaggacattcgcctctttgtaaaacaggggcttgccgcgcatgccgcaccgcgggaaattgaattcaaagataaacttccgaaaacacggagcggaaaaatcatgagacgtgtgctgaaggcgtgggagctgaacctgccggcaggcgacctgtccacaatggaagattaaagacggcgttgacatcgtatcttatttatgttaaaaatgagtaagcttcatacgaaaaggttttgattgagacaagtaggatatctgattgttcaagagagctgatggccggtgaaaatcagcacataagatatgccgaatacactcatgaaccgcttttgcgaacaaagctattccaaggctttcagtagtgaaagaacggacacggtccgttatcaaaaagagtgataaaagcttttttatgcttttattagtagggtggtaccgcgattatatcgtcccttcgttttaaacgaaggggcgttttttattttcataaacaaaggagcagacaaaatgactaacttattagaggatttatcattccgcggcttaatccagcaaatgacggatgaagaaggactgaataaacagctgaacgaagaaaaaatccgtttatactcagggtttgacccgacggctgacagcctgcacatcggacaccttctgccgatattgacactgcgccgtttccagcttgcaggccaccatccgattgcgcttgtaggcggcgcgacgggactgatcggcgatccgagcggcaaaaaagcggaacgtacgttaaatactcaggatatcgttgtcgaatggtcgcaaaaaattaaaaatcagctttcccgatttttagatttcgaggccggagaaaaccccgctgtcatagcgaacaactttgactggatcggaaagctgagcattattgaatttctccgtgacgtcggaaagaacttcggaattaactacatgcttgcgaaagatactgtaagctcaagaattgaaaccggaatttcttacacggaattcagctacatgatcctgcaatcctacgattttctgaatctgtacagagaaaagaactgcaaactccaaatcggaggcagtgaccagtggggcaacatcacggccggtcttgaactgatcagaaaatcagaagaagaaggggcgaaagctttcggtcttaccattccgctcgtcacaaaagctgacggcacgaaattcggcaaaacggaaggcggcgccatttggcttgataaagaaaaaacatcgccgtacgaattctaccagttctggatcaatacagatgaccgcgacgtcgtcaaatacttaaaatactttactttcttatcaaaagaggaaattgaaggttatgctgaaaaaacggagacggctcctgagaaaagagaagcgcagaaacgtctcgctgaagaggtgactgttcttgtacacggccgcgaagcgcttgagcaggccgttcatatctcccaggcgctgttcagcggcaatattaaagagctttccgctcaagacgtcaaggtaggatttaaagatgtaccttcgtttgaaaaagaccgctctgaagaactgtctttagtagacgtgcttgtggaatctaaattgtcgccttcaaaacggcaggcccgcgaagacattcaaaacggagctgtttacattaacggcgagcgccagacggacatcgggcatcttctgactgcggaagaccgcattgaagatcaatttaccgtactgcgccgcggaaagaaaaaatacttcctgatcacgtactgaaaataaaaagcagtccggccgctcaatgcggcaggctgcttttttatgttttgtgaatactgcacggggaaatgagtacagtacatagtataagcaaaacagggaaggggtgctgcgccgtgaatttcatgtttaccatcgcaaaagaaagattgcagcgggatcattgggaacagcagcaaagcataaacgccgaagccaaagccgaggaatcagagacggaagaagaaaatccgacatcataaagggaaagcccccattctgcggaatggaggcttttgattgtcaccatatcagcctgacggcggccatcagcacgactcctgtgatgaccgtgatggataagctttttgtccgtatcgcgcaaagcaatgtcgggatgagaacgatcattgctttccaatcaaaggtcaaagtgctgtttgttttcacaatcatgctttccgttaccagagccgtcaaaatacaaagcggaataaaggagagccattttaaagccaactcaggcatctgaatgttccggacaaatataaacggaacaatgcgcggcacaagtgtaacaatcatgcagccgagtataatccagatcatttgtgtgctgatgctcatttgtccgtcaccaccccgatcgttgccacaatcacggttgagacgatgaccgcgatgtgtgacgggacgaaatacgataacaagaccataaaaatgatcatatagagtattaaggataggttgtgcttcagcttttccgaagtggacgattgcaattgcagcacaagcagcgccgcaaacatagcgggcaaagcaaagtccaggccgagcgcgtaaggatcagatatccattgtccgagaagcccgcccatcacgcaggaaataacccagcacatgtaagcggttatattgaggccgttcatccacttatcgtataacctgccgttctgagccgctttgttcaccgctaccccgaaagattcgtcagtaagcaaagccccgaagccgatatttttcgccaaagagtatttcgtgaaatacggcgcgatggtcaggctcagcagaaggtgccgcagattgacgataaacgtcgttaaaataatggcggaaatcggactcccggaaacaaggagcgagcaaataataaattgggcggcgccggcatagacacacaaagataacaaacaaatttcaagaatgcttagatgagaggcaacgccaacgatgccgaaagcaaaaccgatgctcatatagcccagcagcgtaggcacacaatcccgcaccccctgtaaaaacgtatcgttcatttcccgggaaacggcggttttttgcacttctgtgttaatcattttttatactcctttcatagagattataatgataacgactaatgaaaaaatcaaagaaaatacggttcacatttatatgaaccgatttccggtgacgacatgaaataacgaatggttttgtttcatcaggccttcaactttctcagccccgacttctttcacaagctccgcgaacatcagatcgtgcctcatatattccatggccacgagaacgagagcgggatcttctgatttaatggcccaggcattcgtctgcggagaaaaattggcgattaagacttctttattatcgcgggcagctatcgttaatcttccgcccatccgtttctccgccacttcaggtgacatattatgatttgtcgtatttccgagcttcacttccggagggccgaacacaatcgaaaagacgggcaattgttcggcggcgcgtttgttagcagcttcttgaataaagggaatctgctgttcccagacagacagccacaactcttcctcggctttttcaatcatatccttcatctcattgatgacatgatcattcgtgctgatgcggcggatgacattcatctcctgctcgctttccagtgccaataacttttcctcaaggtagccgaatgagctctcgaaatcgtgccggagccggtcgattaattcctttccggcaagcggagcatatgtaaccggatcagacggcacaatatggacagcgcctttatcaactaatttccccaatacttcatagatcattgagcgggggacgcctgaccttttgctgatttcatatccggtaacaggcgagtgtttcaacaagccgatatatgctttacattcatattgagaaaatccaaacttctgtaattctttcagaacatcctccataaacatcctccgtagtggttattcatgaaactactataatgtaagcggttatatcttgtcaatgggacttgagtgctgaaagaaaggtgcgcctgttttgtcgctttccaacttagtttatggtgagttacatgtatggcttttgtgaaaaacgttgccgtagacccacacgaatgccgtttgatacgataaattcaagaagttaaaaagaggaggatcacggtggaaaacacctctaaaatcgcttttttatcggttataagcaattccctggtcgtcatgctcaaaatagtggtggggatcataaccggatctgtcgcgatactttctgaagccattcattcttttttagatttgatcgccgccttcattgcctttatctccgtcaggatttcaaaaaagccggctgatacagggcatccgtacggtcatggaaaagtcgagaatctgtcggggactatcgagacgattctgatttttgcggcagggatttggatgatatatgaatgcgttcaaaaactggtgaacccggcgccggttcatctgcctgtattgggaattgttgtgatgcttgcgggggctctcattaatttgatcgtttcgaagttcgtaaaaagagaagccgaaaaggttaattccgtggcaatgaaatcaaatgccctgcatttactgactgacgtgtacacatcattaggcgtagcggcaagccttttggtcgttaccgtaacggagtggtacatacttgatcccattataggtatggtgctggcggtgtatatcatatatgaagcgtttaagttaatgaaagaagcattcccgccgctgattgatacccgtttgtcggaagaggaagaaaaaacaattttaaagattattgaaacatttcaacaggaatttattgaaattcacgattttcgtacaagacgctccggcccgcaggagtatattgattttcatctggtcgtagcctctcacgtgacgattaaagacgtgcatgacctgtgtgaccgcattgaaagagatattacgaatgaattcaaacaagcacaggtaatgattcaccccgagccggagagcgagaggaagaaataaatcgatcttaagtttgcgtttgttcccggcaaaatgcctgcaaaaggcccgttcccacgggtctttttgttgtataaatgactatttctcgctcatatgagagataagcttatacacgtgaggggttcatttcatacgttatgttgtaaagaaaaagggaggtgaacagaattgaacgctatttctgttaaagaaattgaacatggagttgccgttgcggaaagagaaggtttaggggagtatttataccaagaaccggtttctaaaaaatgttcgcgccgttcccgcagcagaaaacggacacaccgttctcgcagcagaagacggacgcatcaccggacacaccgttcccgcagcagaagacggacgcatcaccggacacaccgttcccgcagcagaagacggacgcatcaccggacacaccgttcccgcagcaaaagacggacgcatcgccggacacaccgttcccgcagcagacggtctcatcaaaaacgtagccgcaaacgctgttttaaatgctgactgcagactctattacaagtaacggggatctgctataatggcaagagaactgcataaaagatccagtatcatcatctgcggacactgaactgacaacatggcgctgtttgttcgtgtccgttttttatgtcaaaaaagatgccggaggataaaaaggaagggatgacgccgaatgaagctgaatgaggatttttataactctgaaggaaagacagtctctttgccaaacatcagcagcaagcttttgcatatcacggacagcgggcatatcagcgttgacttcatcagcataagcaggctgcggaaggcttcaaaaatcgcgatcttaggtgacagcgtcgcccgggggctgcgtgcggaatacggctttggtgacattctgaaagaccggacaaacgctgaaataaccaatctgtctgtcagcggcgttaatatgagcaacaacggaagcgataacatttatcagcaggcgcttaaaacaaagggacatgatgtcatcattgtccagggaacagatgatgattggtgcaaccacattcccatcggcacagatgaaaaggatatcaccacattttacggaggcttctgccaagtgatccagcagctgcggagcggaaataaaggcgcgagcatcattgtggtgaccccaacgagacaagcaaaaatgtcaaaaggaaaaatcgtccgccgtgatactgataaaaataaactgggcctgaagctggctgactatgtgaaagcccaaaaagaagcctgcacactcctctctgtaccatatgccgatctatttgatactgatctcatcgacccatataatcccgctttccgcagcatgtgcatgtcagaaggtcttcatccgaacgagaaagggcatcaaatcatatttcaggaaatctgccggaattattattactattatgggtaacacagcgctaacagattattttcggctttgcttttctaaaagctcaattattctttgagatgcgtgtttttgcgctctcaaaagcgagacgatattaccggtaaaaccgattaaaatgataagcagcaaaatgatcatccacatagcgaacctcctgtcgagtgttgaaaaacccactctttattttacttattatggatggggagagaataggtctaactattgggatttctttataaatccataaaaaaatgaacagactgaacgggtctgttcatttttattcgcttatttcagcaggttcaatgattcgcgattaaaggcttccaaatcgtcaggtgttctgcttgttacgatgttatggctcacgacgacttcttcatctttataatgtgcgccggcattgattaagtctttgcggatgctgcggaatcccgtgatatcttttcctttaagaaggtcggtatcaatcagcagctgcgggccgtggcagatcgcgaaaacgggtttctgattttccacgaatgctttagtgaattcacccgggcggtcatctccgcgcagaagatccggtgaaaagcctccgggaatcaataacgcatcgaattccttggcgtctgcgtctgagatcgcttgatcgatctttactttctcaccgtgcttgcccgtcacttctttcccagcttccaaatctattgtcaccacactgtggcccgcttctttaaatgcttccgccgggcttgtatattcaatatcctcaaattgatctgtcatcagaactgcgatttttttgctcatacatcatgcctcctgtgaatttgtatatgacaagaatatcaggcagattcccgcctcacaacgtatttgcttatgaaaaaagacccctctgaaaaagaggagccaaaaggtacggaggtctgcttaaacttacgtgtttaacctgagataaggcaagaaatcgaaccaattactttttgcgtctttttttctgctttttacacccgcatttccccggatcgcccggatcaatgacttcgtgaattgtttcttccttataaacgtggcggggaacataacggatatgctctctgttaatgtgtttgatgggatggacgtaaaccacttctttgtcagtatacttgtcagtcacaatatacttagggtcacagtaatacactttcgattttttacccattcatctcacctcccgtactttattaaatgctgacaaggaggattttgcatcggacaagtacaccatggcaagtccacaatttttcagctgcaatttcgtttttctgatttttcctgaatccgcctcaaattggaacggctaaccctttttgagcggggaaatctataaaaaagaattcaaaaacgattcttttctcaggtcaatcgagatgcatacatctttagggggatttcagaatgctcgatgaaaaaacgattgaaatcattaaaagcacagtgccggtcttagaagagcatggtgaagaaatcacaggccgattttatgacctgctgtttcagcatcaccctgagctgctgaatatctttaatcagacgaatcaaaagaaaaaaacacagcgtacggccttgtcgaatgctgtgattgcagccgcagccaatattgaccggctggaaaacatcgttcccgtcgtcaaacaaatcagccataaacaccggagtatcggtgttaaacccgagcattacccaatcgttggaaagtacttgttaatcgcgataaaggatgtgctaaaagacggggctgctcctgaggtcattcaggcatgggaaaaagcatacggcgtcattgcagacgcttttatcggaattgagaaggacatgtatgaacaagcggaaacgcaaaaaggcggctggaaagactataaggcgtttaaaattgataaaaaggtaaaagaaagcaaggagataacgtcgttttatttaaaaccggaagacggacaagttctccccgagttcaaagcgggacagtatatcagtgtaaaagtatacattccggacacgggttatacgcatatccgccagtacagtttgtcggatgtatccggtaaggattattacaggatttccgtgaaaaaagacggaattgtttcttcatatctgcatgaccaattacacgaaaaggattcaattgagatcagcgctccggccggggatttcgtattagaccctgattccaaaaagaatctggttctcatcagtgccggtgtcggaattaccccgatgatcagcatgttaaagacggttgccaaaacccagccgcagcgaaacgttctctttatccatgcggcaaggagcggagagtatcatgcgttgcggcatgaagctgaagaagccgcggaacactcatccgttgacaccctctttatttacagtgagccgtccgaacaagaccgttcagaaaacattcgttttcgggaaggccggattgacaaacagctgttagaagaagtgatgacagataaagatgctgatttttacctgtgcgggtcaccgtcgttcattaaagaaatgaaaaagctgatttctgaattcaatacaccgccggaatccattcactatgaattatttgaaccgcagctgagtatggtgtgattgaagaaggaaggacgatgattttaatgtatgaagcatccggactgggtgctttttttattctcttgcaaggaagggttgctgaggaatcactctgtagaggaaaaccactttttgtctcaactcgcttaattatcgaatgaaataagtgccgcatgttaaaaacacatggcccgcgagtttattgctcacttatcctgctgctcggatttttggtgtgtgagaaaaaaacggtacggctgcataatccggaagagacgctgaccttttacttgtaaaagaagtttaaagacaggatgaacgcttatttgctagtgtacgagcggcaaaagcaaaaagaggaatcagtattttaaaattaaaaataacaactgatagaaatgaaagtttcaggatacaatgggatttatatattcgggttttgtgatagcagtatagggaggggaataatagagtgagtaacttttttgaggaatcggtacagggaggggttgtatctatgcttactgatattaaacaaaaggtttggggatgctcttttatctgagaatcgatttgagatgaagcggggatgccgaggggatcagagggcgaacgtcaggcagaattacgccaagtggaccgccgagaaaaatggctctggaaatgtgaatctattgttgattttcttgattgagctactgaagaaatagttgacgagaaacaccggactgtctttgtagtagacggggtgaaatatcgtgaaatcgctctgcattctggcgtttcccgcgaaacggtcagacgcatcaaagagaagattttttgccaaatatgtaatttttattgttgaaacagataaaatccgcagtgtagactggaaggcaaaatatttctgcgtccccatcgattcaaatagggattacaataatgtgaagagttatttataaacagaaattgataaataatataagatcagctgacaaacttaatgaggatcaaactagtgctcacttatttataaattaaacatattataatgatatattaatcattaagggagatgagcagctgatgggttatgatcagcatagaagatgccctaaatgtaaacaaaaactaccgaaaccaaactgctgtaagtgctgtcccatctgttatacaaaagttattgtaggacaacgaggattacgaggggtgcgagggattccaggggttacaggaccagccggaccagccggaccagccggagcgaccggggccacaggagctatcggtccagccggagccacaggagcgaccggggtaactggagcggcgggagtcacaggagcgaccggggccacaggagatatcggtccaaccggaccagccggagccacgggagcagccggagccacgggagcgaccggggtaactggagcgaccggggtaactggagcggcgggagtcacaggagcgaccggagatatcggtccaaccggagccacgggagcgaccggggtaactggagcgacgggagtcactggagtgaccggagccacaggagatatcggtccaaccggagtcacaggagccacgggagcagccggagccacgggagcagccggagccacgggagcgaccggggtaactggagcggcgggagtcactggagtgaccggagccacaggagatatcggtccaaccggagcgaccggagccacgggagcgaccggagccacgggagcagccggagctaccggagcgaccggggtaactggagcgacgggagtcactggagtgaccggagccacaggagatatcggtccaaccggaccagccggagccaccggagcagccggagctaccggagctaccggagccactggagcgaccggggtaactggagcgacgggagtcactggagtgaccggagccacaggagatatcggtccaaccggagcagccggagccaccggagccacgggagcagccggagccaccggagccacgggagcagccggagccaccggagccacgggagcagccggagctaccggagccaccggagccactggagcgaccggggtaacaggagcgacgggagtcactggagtgaccggagccacaggagatatcggtccaaccggagccaccggagccaccggagcgaccggggtaactggagcggcgggagtcactggagcaaccggagccacaggatctgggctatcagaatatgcttatgtgtacaatctaagtgcagaaacggtagctatagaggctccggtaatttttgactcaactggaatcactactgctggcattacacatgcccctggaacagctcaaattatagtaaccactccaggagattacgaggtcactttttcagtctcgggtgtagagcctaaccaattcactttatttgtaaatggagggccggtgacgaacacagtttacggttcaggagctggtactcaacagaacaatggtcaggccataattactctagcagcaggtgacattcttactcttgtaaatcatacttctgcagcagcagttactcttcaaactttagcagggggaacgcaaacaaacgtaaacgcttctattgttctcaaaaaattaaattagataagtggtttaaatctccatattaaacaagaaatgagaatgacttaaaaaagcttatagagcttaatatacagctttagaaggatgaagaaatttaaaatataagcaaactcatctaatttttttatataaggtattatggtaataggtaataaacaggcaggcgctttcccgcaggggagggtgctttaaatttaaggacaaaagcctccaactgttaagcgagtcaacacagtaggaggcttttctcttatgggtggtacagcagcagtattctcttacaaatcaaatattcccagaaagttatggcagtattcgtctctcgagtaatgaaaaaagttttatgttctctgtaaactgcgtccggtaaatctcgggataaacgattggcggttaacgactgagtacgggggcagtttagaaagaatatgattggagggattacataaaataattagtcaagccttagaggaattaggaaagaatgtgaggtgtgcggctgaaagggtgccaaatctcaaccctgttattatccataaaaaagacatggcagcgcaactacaggaattcagttcggatttaggcttgtcagcagatctccatcattgcctagataaaaaggtaaagaacttattaacggcgtatatggctcacaaacggcatatgcaatccatgattcctgacggcatttagggttaaaacaaaagcaaagcgcgaatctctactaaacagttactttaggacttctcaaaaaggaactcctattaaagggagcagggttaattttcaaattgtttaaataaaagtaaaaatatagtatgttagaccagaaaacaaatgaaggaggatttgtatgaggttgttaaaaaactcaatctgtttacttgtcgcaactctattgtttgctattggattttcgccgcaaacgaaagcaacacaagagcactcgtttggattagcaaaaccagtaacctttgaagaaaaagaaactttaacagtaaataagaatggagtggctaagagcaataataatggccaggcttccgtcattaaggaggcacgacaacttgccaaacaggatagccacaatgaaataacctataagagccccttagctaaagaagaaaacaacattgttaatgtgccagtcgttgagaaaaaagaagagaaagcgcacactaaagcagctagcttagttacgatgtcctacacaacaatatatgaccccaacaaaaaatccacacaaccacaattaaaatagcaagcatagttggcgaaaagccgatagttatcgaagcaagaaacgatttatatgaaagtaacacttatagcggaaaatatggaagggtttttctccataacagagaatttttaggaaaagacattaaagtaggtaaatcatattcaaagtcgtattatcctaaaaagacaaagttgatccaaagtggaattggagttgattcgatattcaccatgtgcttccgctaaagtatgggggaaaaaataactttaataatttgtatcctctccctcgtgatatgcaccaaaatctattaaatccttggtgggataaatattaataagtaagaggtggctcaatggcagtttttgttgaaaaaacgctccaaggtctaaaagaattaattgatgaaaaaggccgcttaaaaattttagggaatgaaggaactcttttagagacagaatgtactttctctaaaggtgcaacagatctggagattgagagttttgagaagaaaataaaagtctcacttcctgaagattataaaacctttttaaaattgcataacggagccagaatatttgatttgttgatttacggtgagaatgcaggtgggggtttgcatattcttaatttagaagagattgaaaagtatatgcaaaatggttttttagagcctcagtttattcccgtctcacatctgttagacggatgttatttgttaattaacaaaaccaaaatgtccacagatccaaactatttatggttccgcagatttattgagtatgaaccaatgcaacttaattttgagatatttttagataggtatattttgtctcaaggatcaagtttttgggaatggaatatctatactgctgaaaattattataggactcaccagggtgatgaggattaacctttcctacagttgggttggttcatttttactattagacttcgatttgaacttttaaaaataggtttaatttaggagacgaaccgattaattggtgtatagaggatttataaaaagcgcagatactctgcgcttttttatttaagtattttccgaatcattcgcagcccgtttttggaagaaggataacggaaagcgaagtcgaagcggttcgtttgtttgacgacgctttttttgtgcgtaaacgtgttaaagctgtcaaatccgtgatagctcccgatgccgctttccccgacgccgccgaatggcaaatacggcgtcgcaacatgcattaacgtatcattgatgcagcctccgccaaacgacagattctctaaaacagcgcgctcagtttctttgtttgtggtgaagagatacagagcgagcggctttgggcgcgattggactttctcgatgacttcatcgatatcaccgtatgtaaacagcggaagaatcggcccgaaaatctcctcctgcatcactggagagtcatccttcacttgatctagaatcgtcggcgctattttgtggtgatcaggattaaattgtccgcctgtaagcgggacgccatcattcagaaagctgagcagccgctgatagtggcgttcactgacgattttgccgtactgcggattttgttcaggctgaggaccgtaaaattcgctgatcgcacgcttcatttcttctgtgagcttcattttgatatcttggtggacaaataaataatccggtgcgatgcaggtttgccctgcatttgtaaatttcccgaagataatgcgtttggcggcaagctgtatatcagcatccttatggacaatgcagggacttttgccgccgagctccaaggtaacgggaattaattgtttggcggcggcctccatgacgatttttcccacggcaacgcttccagtgaagaaaatatagtcaaagggctgctgtaataactcagtgctgacgtcgggcccgccttctgccatagcgacatagtcactcggaaaaacgctgctgatgagtttggaaagaacagcggaaaccgccggcgtatattctgacggtttgagaacgaccgtgtttcccgctgcaatggctccaatcaacggagaaagcgccagctgcaagggatagttccaaggcgcaatcaccaaaacggttccatatggctcagggataattatgcttttcgagcctaggtgagtcagaggcgttttgactcgtttcggtttgatccattttcccagccgcttcatcacaaaactgatttcctccagtacaattccgatttctgtcgtgtacgactcctgttcggatttgtggagatcctgatagagagcggctgttatatcggcttcttgtgttttgatggcttgtttcagcttttgcagcatgttcagtctcgattctagctgtctcgtatgccccgccgcaaaataggctttgtgcttgctgacgatagaggggatgctgttcattcagtcgctccttttttgtaaggtatgatgattcattatgtaaaaaatcgcttctgcttgtcaaatgggtttttctaatgtacatgtagctgaaaagccagttggcacataaaaaaagcccctgtccggggctttttttaataaagagagggagcatctgtccattattctgacagcccaaaagaaaaaccccggaaacattgtcatcacaacatgtccggggtttaatccaatgctctttaaagagcgttttacttaacgggagtagaactcaacgataagcgcttcgttaatttccggagcaagctcagagcgctctggaagacgagtgaatgtaccttcaagcttttcagcgtcgaaagtaaggtactcaggaacgaagttgtttacttctacagattctttgatgatagaaaggtttcttgatttttcgcgaacaccgattgtttgaccaggttttacttggtaagacggaatgtcaacgcggcttccgtcaacaaggatgtgaccgtggttaactaattggcgtgcttgacggcgagtgcgtgcaagaccgagcttgtacacaacgttatcaagacgtgcatctaaaagaatcatgaagttttcgccgtgtttaccagtcatttttgcagctttgtcaaacaatgtgcggaattgacgttcgtttacaccgtacatgtgacgaagtttttgcttttcttgcaattgcaaaccgtattctgatagttttttacgctgtcccggaccgtgggggcctggtgcgtaagggcgtttttctaattctttacctgtaccgctaagagagattcctaaacggcgagacagtttccaagatggacctgtatagcgagccataatgtgactcctcctttggttttattttgtggaaaataaaaaccgtctgttcgatccgaccgtgcacattttgttttcatgtatcctcgctccagcagcagagagttacacgatacaccttacagctaaggaacaaaatgcaaacacagaagctgaacaaaaaggctgcaatatttcacacaaagaacattatatgatttttccccgccgccgtcaaccatttctccatgaagagtgccggtttatgatataatgtacaaaaatgagtagtacatgtttaggtgataaaaatgaaaaaacaaacaattgatgaagtgacggcctttcatcagaaaatgctttcttttttcttaacgaaatctgaatccgtctcattatccgactcgctgttatggctggcctcagctctagaatcctgctttacatctctttcattgaccctttcaccggcagaatcaacacgtttcaccataaaaacagaagatgaaccgcattatgctccgctgaaagagagtgacggccgttttatgatcaggaatcagacctccggcagatccttttatctgtgctcggaaggcgggctgccgatcccggaatcattgcctgagatcgttactcagtttattaatcaatctgtgagacaaagcgggctgtttgacaaaacgaagcatcagcggaaaattcacagaatgacagaaatgttccattcgcttttggaccaaaatgaggttttggaaaaactgcaggcaagtttgagtacggctttccggtctttccgtttttcactgtttatcacgcaggatcaggatacggacagacagcttcccgcaaaagaattacatatggacggaaaagatgccgatccgtctgccctgaaggtttatttatcggggagactgctcagaaaaggcaggtcatctgcttatctgccgatcaaaggccagcaggggacttacggggttctgaagacggaggggctgcaggatgccgttctttcgtgcagtactctcagtgaaatgctgctgcttgcgggcgcagcgggaaaagcatttgaaaatgcgcagctctatgagcaatcgaaaaaaagcattgcgaatctggagctcattaatgaaacatcgcgccagctgaatcagcgcctcagactcactgatacgatgcgggagctcgccgccattatgacccaatcgtttcatgcggaagaagtggctttttttcatattgatcattttgagacgcaaaatctgcttccgggacataccgctttttttaagacagaacgtgcgaacccctatatcagcattgtgaaagaaaagctgttcgagggagaaaagggcgtgtttatcggcagcggaaagactgtattcggcgaaaacggtttcggctcgctgatggcggtgccgatgatcgaaaatgacaccgtcttcgggttcgcgattttattgaaaaaggatttgtatgcttttacgtttgaaatgtataagctttttcaagcgctcattcaccatgcgacattggcggtcacgaactccatgctgcgcgacaggcttgagcatcttgttcagacagaccagctgacggagctgtattcaagaacctatttggatgagaaaattcaatacagcatgaaaattcataaacggggtgtattcatcctcgttgatatcgataatttcaaaaatattaatgatacatacggtcatcaaacgggagattcgatcctgattcaggtggcctccgttatgaagaaccatattcgtgagcatgatgtcgctgcgaggtgggggggcgaggagctggctgtctatctgccgaatatcaacgtgtcatccggagaacgcatcgctaaaaggctggttcgcgccatccgggaaaataccgagccgcgcgtgacgatttcctgcggcgtttcctgctggtcaaagaccggcccgatgccgttgaaattgctcgttcagcaagcggatgaggcgctttatatcgccaaacggaacggcaaaaaccggctgatcatccatcaaaacagcacgacgacataaaaaaggagccggcctgccggccgggctcctttttttatcctaatcgtttttcaagcgtttcaacaaactttgctaaataggtttcgtccgtttcatcaaaacggtttttcacggggctgtcaatgtccagcacaccgatcacttcaccgtttacgcggatcgggagaacgatttctgactgggaagccgcgtcacaggcgatatgtcccgggaacgcattcacatcggcaatccgctgcacgtcgccattagagtaggcagtgccgcatacgcctctgccgaacggaatgcgcacacaggcaggaagtccttgaaacggtccgagcacgagctcgccctctttagcgaagtaaaaccccgcccagttgacttcatgtaatgaatggtataaaagcgctgacgcattcgcgtaatttgcgatcgcatccgtttcatcttctgtcatggcttcgagctgtttaagcagaagctgataacttttttctttatctccggattgtttttcgacatgaaacatggaaaaccctcactttttctataatatcaaacaaagttccggccgttctgccggcatttgtcgagaagttcttacaggaacggcgcctttctgcttgaattgttacacataaaggggtgagccgtatgaaagtaagcactaaagacaaaattattaacgccgctgtccagctgtttaaccaaaaaggttattccggcacgtccgtccgtgaaatcgcaaagtcagctgatgtaaatgttgcgcacatctcctactattttaaagggaaaggcggattaatggaacatttagtttccgagttttacgaaggctatactgaagcgctggaaaaagccgccgtcagtatgaagggtgaagacgcgcaggaacgcatcctgcgggtgattttcgatattttatcctatcagcacgataaccgtcaattaacgcggtttgtataccgggaagtgacgattgattccgtgcttatcagggaaattatgtctacttacttaatgaaagaaaaatatattttccagctggtgattgaagaagggcagtcacgccatagacggctgacgctgcccgtgccgcattttattctgcaattgaaatccctcttgatgatgccgtatctccagcctcaatatattacggaggtgctctatatgcagcctcatgagccgtacttttataaaaggtattttgaagaggtgaagatctggatcgaaagcgtgttccgacggcctgatgcggcgcttatgaagtaatgatgtttttgtacgtttcgtaggaactgccgacatcttccgcttgatgggcgtccgacccgaatatgagcgggatttttttttgcttcgccgtctcagccatccaatcctccatgtatacttccccggcaaacttctttctgagcccggatgtattcacatccagctccattccgtgttctttcacggcgtcaagacagcgggccgcaagctctcttatttgaggtgacatgctgtaagggaaaaggcgcgcgaattttttgacgagcgtgatatggccgacccgttttggcttaaaggggccgagcggtgttacaatggaagaatacacggtttcatagtattgttcatatacggcttcaacgcttccgaagcggtcggcaagctgctgaaaggcgtgctcgtcaaaatcgaggcatatataagacggaccggttttcaaaaaatgaacggataaaatgccgtcatccagtgaggggccgtacgtgttcagaaacgccgcggtttcctcttcataccctgtgataaaatcggtttctagcccagtcagaatgctgatttgtccatcgtattcctttttcagctgtgacagccgctccaaataaacctccatctgtctgagatccatcgcgctgtcctgaagcggtacgggatcttgaaatgacggaggaaggggggcgtgctctgtaaatgtgatcgagtcaaagcctctttccagggccttttcgacatattgtttcagcgcatccttcgagccgtgagggcaaaaaggggtgtggatatgagcgtctcgtttttccatttgtgtcactccattaaaaaattgcagaatcctgccgaaattatgcaaaaagtttttgatttctggtcaaaaaatgttggttacatggtatcataataacaatgaaaacgacagattttctcaatacatatattgaaatctttctgaatacataaaacaccctgacagattaagagaacaacaagggggctcattatggagttagtcatcggattattggttatactgctcgcgctctttgcggcgggctactttttcaggaaaaaaatttatacggaaattgaccggctggagtcatggaagattgaaattttaaaccgttcgatagtggaagaaatgtccaagatcaaacatctgaaaatgaccggagagacggaagagttctttgaaagatggcgcgaagagtgggatgaaattgtcacagcccatctgccgaaagtagaagagctcctttatgatgccgaagagaacgccgacaaatatcggtttaaaaaagcgaatcaggtgcttgtccacatcgacgacctcctcactgctgccgaatcaaatatagaaggcatactgcgtgagatcagcgaccttgtgacgagcgaggaaaaaagccgcggagagattgaacaggtgcgtgagcggtattcaaaagcgcggaaaaaccttctggcgtacagccatctctacggagagctttataacagcctggagacggatctcgacgaaatttggagcggcataaaagagttcgaagaagagacggaaagcggcaattacatcaaagcgagaaaagtgctgcttgaacaggaccgcagactggatcagcttcagacatacatagatgacgttccgaaactgcttgcggactgtaaacagaccgtgccgaaccaaattgccaagctgaaagacggctaccgggaaatgacggaaaaaggctacaaattggagcatattcaaatcgaaaaagagctggagaccctcacaaatcaattgaaacgggccgaaaacgcgcttttagaagaattggatgtcgacgaagcgtccgccatccttcagctgattgatgaaaccattcaatcgatgtatgaacagctggaaggcgaagtggaagccggacagtccgtattaagcaaaatgcctgagctgatcatcgcgtatgagaagcttgaggaagaaaaagaccgcacaaaaaccgaaacggagctcgtcaaggaaagctatcagctgacggcgggagaaatcggcagacagcatgccttcgaaaaacagctggaaacgatcggccggctccttgagcaggcgagagaaaagcttgacggcgagcatgtagcttactcgctgctgattgaagaagtcgaggccatcgaaaagcagatggaagaggctcagaaagaacatgccgaataccgtgaaaatctgcaggcgctcagaaaagaagaactgcaggcgcgggaaacgctgatgcatcttcggaaaaccatttctgacacggcccgaatgctgcaaaaaagcaacgtgccgggaattcctgaacaagtcaaggacaagctcgagacggcaaatcatcatatagaagaaaccgtcagccaattggaagagctgccgctgaacatggaggaagccgccaaacatctggctgaagccgaaaaggtggttgaggaagtcagtgaagaggcggaagatcttgtgattcaggtgaagctgattgagcggatcatccagtacggcaaccgcttccgaagccagaatcatattttatccgaacagctgaaagaagcggaacggctgttttatgcttaccgctataatgaagcttatgagatggcggcagatgctgttgaaaaagcagctcccggcgccgtgaaaaaaattaaagctgatcaatctgcttcatagacgcataagcaaaaactgcaccctgatggaaatcagaggtgcagttttttagtttctcacggaatataaaaagcgcctgcggctgatatacatcaaaccgcaggcgctgaatgttacgattttgctttatttaattcgatgggcgggctggtaaaaaacgtgataatgcagccgatgatcgctccggcaatgcccggaagcacccagccgattcccatgctgtaaagcggaagatttgcgtttaagaatgaatctaatgatccgagcggaatgccggctgccttcaaaccgtccaggatactgaacagccccgttccgatcaggcaggcgatatagacttcgcgtctttccttaaagattttatcaataaaggaaaggacgataatgacaatcgccagcgggtaaatggctgataaaataggaactgaaaatgcaataatctcagcaagtccgaaatttgaaatcgccagactgaacagcgtgacaatcgtaaccaccattttgtatgataaagctggaatcaattttgaaaaatattcgccgcaagatgtgacaagcccgatgcttgtcgttaaacacgcaacggtgatggcggcgccgagaacgatgtttcccagtgaaccgaacaggtaatcagatgaagctgataaaatctttgcgccttcgccgagcggccccacagcgtccgtgcttgtcgctcccaaataggccaaagataaataaatgaatgtcaaacctgccgctgcaatcagacccgctttaatacaagcggcggcgagcgctttacgctgggtgacgcccctgcttttaacagcgttgacgacaacgacgccgaagacgattgaggcgagcgcatccattgttttatagccttccaaaaatcctttgaacaccggcgttccggaatatgcctgatgtacggcgcccagcccgcccatcggagtgacaatggcttttacgacgatgattaaaataataccgaatttaataggagtcaaaatctttccgactctgtccacgattttggaagggttaagagctaaataatacgtaatagaaaaaaagatcaacgtgaaaacaaataaagataatctttccggaatgccgcttaaaaacggaactgcaccgatttcatatgaaacggttccggttctcggaatcgcgaaaagcggcccgattgataaataaagcacaacggtgaaaatagtcccgaataccggatgagctttatcggcaagccctttcgcgtctttgcccgttaatgcgatggcgataatacccaaaagcggcagaccaacgccggtcagtaagaaaccgcccatcgctttccagacattatgccccgccgcttgcccgagctccggcggatatatcatatttcctgccccgaaaaaaagtgcgaaaagcatgaaaccgataataacggtatctttgacaggtagtgagtgtttcataaaaatcctcctaaatactatgttgaaatattctgtcaattaattgtcagataatataacaaaacgaacattacttattatatggcaatgtacagagaagtcaatactcgatttattgcgaatttatatttacttttgttatggtagcataaatatcatacgatgtaccgttttcattaaaggagtaaaaaaaatgatatatttagacaacagctcaacgaccgagccgtatgaagaggtattggatgtgtacaaacagacgagcagccgttatttcggcaatccttcgtctctgcaccggttaggaactgagacggaacagctccttgaagcggccgctcagcaaataaaaaaaaccttgcgtttaaaaaattatgatattgtatttacatcgggcgcgactgaagcgaataacgctgcgttaaagggagcagcctgggcaaacatgagtaaaggaagacatatcattgcttcggcgattgagcatccttctgtgacggagacgcttgatcagctgacagagctgttcggctttgaagtcacatatcttccggccgatcaaaacggcttcgtttctttgaaagacgtcaaatcggctatcaggccggatacgataatcgtcagcgtcatgcatgtcaataacgaagtcggctccattcagcccgtaaaggaaatcggcgggtttttaaagcagcaccggaatattctgtttcatgttgatcatgtgcagggcattcataaagttcccctgtctatagaagaagcgggcattgacctttgcaccgtttcagggcataagtttcacggcttaaaagggaccggagcgcttatcgtcaaaaaaggaacgcggctcattccgcttataacaggcggctcgcagcaaaaaggcgtccgcgccggaacggaacacacggcaggcgccgtttcccttgcgaaagcgatcaatctttccgcgcgtgacatgaacgagcggctttcttccgtggaggctgccaagaatgcgctcatggaaaggctgagcgggacggacggggtcgtcatcaacacccccgctgaaagcagcgcgccgcatatcattaatttttccgttccgggcgtgaaggcggaagtgctgctgcacatgcttgaggaaaaaggaatatatgtctccacaaccgcggcatgttcggcaagagagcacaaaccgagccgtgttcttctgcaaatgaataaaggcgaacagattgcatcaagcagcataagagtcagcctgaacttcagccatacggctgacatcacggagccgtttatggccgcgctggcgccggctgttcaaaaactaaaaaaaatgatgaggtagcatatgaattacgatcatattttaatccgctttggtgaaatatccacaaaaggaaaaaacagacgcagttttattgaaagattaaaacagaatatccgcctggtattaaaggattataaaaaagtaaaatacttttcaaaccgggaccggatgtcaattacacttaatggagaaaacctggaggaaatttgttccttattaaagaatatattcggcattcaaagctttagtctcgcaattaaatgcgaaagcaagctggaagacattaaaaaaacggctttagccgcgatagaaggcgaatataaaccggggaatacgtttaaggtcgagaccaaacgggcttacaaacagtttgaattagatacgaatgcgatgaacgctgaaatcggcggccatattttgaaaaacacggatggattaaccgtcgatgtgagaaatcccgatattccgcttcggattgaaatcagggaggaagcgacattcctgaccattcgtaacgaaaaaggcgccggaggccttcctgtcggttccgcgggtaaagcgatgctgatgctttccggcggttttgacagtccggtcgccggtttttacgcgatgaaacggggattatcagttgaagccgtacatttcttcagtccgccgtatacgagtgaacgggcaaagcagaaagtcatggatctcgcgggatgcctcgcgaagttcggcggcagtatgacacttcatatcgtgccgtttacaaagacgcaggaactcatccaaaaacaaatcccggagaactatacgatgacggcgacgcggcgtcttatgctgcaaatcgcggacagaatcagagaagaacggaaagcgctcgcgatcattacgggagaaagcctcgggcaggtagcgagccagacgcttgaaagcatgtatgcgatcaatgcggtgacggcaacgccgattttgcgccctttaatcggaatggacaaaacagaaatcatcgaaaaatcaaaagaaatcggcacttatgaaacgagcattcagccgtttgaggactgctgcaccatctttacgccgccaagtccgaaaacacgcccgaaaaaagaaaaaatcgagcacttcgaaagcttcgttgattttgaaccgctgattgcagaggccgctgccggcatcgaaaccatcactgtttactcagagcaggaagctcacgataagtttgccggcctgttttaaaactgtatacaattaccactgtttactcagagcaggaagctcacgataagtttgccggcctgttttaaaactgtatacaattaccaaagtttttttgaatgaagacatgtgttttatcacattctatactcacaaggaggtgatacacatgtcacaacaatcaaacagcggaaacagcaaccagcttttagtgccaggcgctgctcaagctatcgaccaaatgaagtatgaaatcgcttctgaattcggtgtaaaccttggaccggaaacaacttctcgcgccaacggttctgtcggtggagaaatcacaaaacgtcttgtctcttttgctcagcaaagcatgggcggaagcagccagcagcagttttaatcacaacttcacataatggctaagagagcggggaattccccgctcttttttcatgagtatagatagaaggcgggaagcaatttatgcatatttttattgtaatggcctatgtttatgtataatggggaaagaaagtgaggagttgttcgtgttaaaacgagaagatttaatcgccccaaagaactataaccttgtaaatgaaatcgaaaagttcagccgttccaaagagaagaacgcgcttatttgggaagatcaaacaggcggcaagaaagtctggacgtatgaaaaattgatggaagaaacgaataaaatcggagcccgcctgaaaggtctcggatttgaaaaaggcgataagctgattgtcatggttccgagagtgcttgaagcgtatgccgtttatttagcgatcttaaaagcggggatggtcgtcattccttgctcggaaatgctgcgcgccaaagaccttgaataccggatcaaacacgccgaagtgaaaggcgctatcgtttatccttcatttataaacgcgtttgacgaggtgaataccgaacagctggtgacattgtcaatcggtgaaaatgatgccggctggaaaaacctcctaacgattgaagcggatggagacagttttcaaacagctgatacaacaagagaagacatggcgtttttgtcctatacttcaggcacgaccggccagcctaaaggcgttgtacatacacacggctgggcctttgcccatttaaaaacatcagccggtgcatggctggatatttctgaagacgatacagtgtgggccaccgcggcgcccggctggcagaaatgggtgtggagcccgctgctcgcaattctgggaagcggcgcgacaggagtcatttatcacggcagattcagcgccaagacgtatttagagctgctggagcgccatcaagtaaatgtcttctgctgtaccccgacggaataccgcctgatggcaaaagtggaggagttggacaaatatgatctttctgcccttcacagcgcagtttctgcgggtgagccattaaaccgggaagtcattgacgtattccggaagcatttcggcattaaagtgagagacggatacggccaaacggagagcaccctgttagtcggcgtcctgaaggatatggatattaagccgggaagcatgggcaaaccgacccctggaaatcaagtggagattataaacgataaaggcgaaatatgcgaaacaggcgaaacgggcgatatcgccgtgcatctgagcacaccggccttattcaaggaatattataaagatcccgaaagaacgaaaaagcagattcgcggagattactttcttacaggagaccgcgcgaaaaaagacgaggacggctacttttggtttgagagccgcaatgatgacatcatcgtcagctccggatatacaatcgggccttttgaagtagaggacgcgctcgtgaagcatccggaagtgaaagaatgtgccgtcgtggcgagcccggatgaaatcagaggttcaatcgtaaaagcctatgtcgttttacaagacgatgaaaagcgcagtgatgaacttgtcaaagaactgcaaaaccacgtaaaaacgattacggcgccttacaaatatccgagagaaattgagtttgtcgaaagcctgccgaaaacggcgtccgcaaaaatcagacgtgtggagctgagacagcgtgaagaacggctgaaggctgataaaaaagcataatacaggataaagggtgagcggggatgaaagcgatttggcacggcggcaccatctatacaatgctggacaagaatcatgtcactgaagccatttataccgaagaaggcgtcgtcaggcagacgggcagcttccgggagctccaaggaacatacggttcgcctgatacggaggaaatcgatttacatggggctgtcatgttcccggggtttacggacagtcatatgcatttaatcggacacggggaaaaacagcttcgcctcgatttgtcgcagctgacgtcaaaagaagcgatactgcgggccgcaaaagaagcagagcgtgaattggaagatggcgaatggctgatcggcgaaggctgggatgaaaatctgtttgaacagccggattacgtcacgaagcatgaccttgacccgctctttcccgaccgccccgtcctgctgaagcgggtatgccggcacgccgcggcggttaattcggccgcattgcgcgcggcgggaattacaaacgaaacacctgatccaaacggcgggattatcgtccgggatggaaccggtccgacgggccttctgctggataaagcccaagagcttgtgacacaggctctgccgcccgtctcacttcactatgtcaaacgcgcgcttcaaacggcgattacggactgctggtcaaaaggcctgaccggcgggcattcagaagatctggcatactacggagacgcgtccgttcccgttgccgcgtacgagtcattaaccggcagcggcctttatccttttcgcgcccatctgctcgtacatcacgaagccgtcgacagctggagcgctctggataaatcgaccggaccttatttggaatacggagcgatgaaaatttttgctgacggtgcgctcggaggcagaaccgctctattgaaaaagccttaccatgatgatccgtctgtttccggcgttcaggtgcatgatgacgaaacccttgccgctcttgtttataaagcgagagagaaagggatggagatcgccgtgcacgcgattggcgaccttgcatttgaaaaggtgctggatgttatcgaaagatacccggcaaagcccggacagctagacaggctcattcatgcgcaagtattagatgacggattgattgaaagagccgcccggctgccgatcggacttgatcttcagccgcattttgtggccagtgattttccgtgggtgattgacaggctcggagaagagcggatgaaaacggctttcgcctggaaaacactgctgtcaaaagggctgctgtgcgccggaggttcagatgccccgattgagccggccgatccgcttctgggtattcaatcggctgtgctccgtacgagcaagcagcacccggaaggtccggcctattatgaaaaagagtgtctgaccgtgtacgaagccattcagctttacacggagggaagcgcggccatcatccataaagaacatagccgcggacggatcgcccccggctatgatgccgactttaccgtactcagcggtgatccgttcaggacggacccgaaaaagcttcatgaattggaagctgtcaaaaccgtcgtcggcggccgtatcgtatatgaaaaagaggacaggcagtgatgcccgtcctctttttttatgataaaaatgatcgttttactttttcccagaaagagttgtctttcagtttcaccgttttgatttttttatcggatagtctaatctcaacctttttgacattccgcgtgctgagcgcttcattatcaagcccgataatcggatgctcattgccgccttgcaccacctgcagtgtcagcttccggtctgagcttaaaataaacggagatccgagtgtacggtatgtgttgttgttcaacgacgccagttcggatacctgcatgcaggaaatcaaaggatcaacaacggcgcctgaaacagatttattgtaggcagtgctgcccgtcggggtggaaatgatcatcccgtctcctctgaacgtctcaaaatgaagatcatcaattaacacatccatcacaaacgttttaataatgcttgaacggatggaaacctcgtttaaacagtgaaaatgattgctgccgtccaccgttacgtgaatgagcgggtattttctgacctcaagctgttccgcggtcatgctggccgccattttttcaggatcatcgctgtgaaaatcacagtacaaatgggctttcccttttttagcgatgccgacatacaggcagtcatcacggaatccggtttttctgacggcttgcagaaatgagccgtcgctgccgatgctggcgataattccggcatcctccggttgagccgcaactgtaaaaccgtgcgattcagcaagctgcttcaaagagctgacttgttcttttgtttcgttgttttgtttgtgaaaaaaataaacattgcggcgaagatcggtcatatccccattcccctttgctgtcatatttacgtttttctcccagcaggtattgtgttaaaatacctgtggcaatagtgtaacatgtttcctgtttatccgttaagggaaagcgcttcatgaaaaaaatgaatctttttttacgggggaacgtacgaatattgacagaaaaggaggagaacaaatgaatgcaaaaagatggattgcgctcgtcatcgcgctcggcattttcggcgtatcagtcattgcaagtgtgaccgtcggggtgctgaagaatatcggagatacagggtctgactttgcatcactgacagatgacacagaggaagtgacgctggataagggcagccccggcagtaaaatcgccgtgcttgaagtggacggcacgattgaggataacggcgggtccgctggcctgctcagctcaggcgggtatgatcacagatcatttttaaaacaggttgagcgtgcgaaagaagataaaagcgtcaaaggaattgtgctgaaaatcaattcacctggcggaggcgtatacgaaagcgcggaaatacataaaaaactggaagaactaaagaaagaaacgaagaaaccgatttatgtatccatgggttccatggcggcatcgggaggctattatatttcaacggccgccgataaaatctatgcttcaccggaaacgctcacgggttcactgggcgtcatcatggaaagcgtcaattattccaagctcgccgatgaactcggcatcaagtttgaaaccattaaaagcggcgcgcataaagacatcatgtccccgacccgcgacatgacgaaggaagaaagaaagatcatgcagacaatggtcaacgattcttatgaaggatttgtcaatgtcatttcaaaaggccggcacatgtcaaaagcggatgtgaaaaaaattgccgacggccgtgtttacgacggcagacaagcgaaaaaaatcggcctcgttgatgagctcggtttttacgatgacacgatcagcgcgatgaaaaaggaccataaaaatatgaaaaacgcttcagtcatcacatacgaggaaggattcggattaggctcgctcttttccatgagcgcagcgaaaatgtttaaaagcgaaattgattttctgaatatgaaagaactcatttcgcaatccggttcgccgcggatgatgtatctctatgcaaagtaggggggaagaaagaatggacgcgacttacgaaggctttcacggcaaagaagaggaagccgaacaacagagggcgcccgagcaggcatatgcgggcttttggatcaggttttgggcgtttcttcttgattggctggtggtctggggacttaaccatctcatcgtttcaccgattttcacgctgatgaagctcccggcaacaagcggaatgtttacaatctcagcttattccgtcacaaccctgatcgtctacctcgcctattttgtgttcatgacgaaatggtttcatcagacactcggcaagatggtcttcgggttaaaggtcacttctttgacgcccggaaagccgctgacttggagcaccgtcattttcagagaagcggtggggcgttatatcgataaaatctggattctctatatcgtcattgcgtttacgcccaaaaagcagggcattcatgatctgatcgccgacacaacggtgattcacgaagcgctgtaccgcaaataaaagcagtaaacccggaataaacgtccgggtttattttttttggttttggcgataatgctgctaaggaagtgaagcttatgggatatgccgcagcagctgttattctcattctcattttggcctggctgctcatgaggatgaaaatccacctgactttcgaatatcttcacgataaagataacgacaaactgacgtttaaaatctcggccttatacgggctgatccgtattaaaaaaacgctgcccgtcattaaagtaaacagcgaagacgcgtcaattgatgtcaaacaggacacaaaatcagaaatgaaaggtcagaaaaaagagaagaaaaaaatcacatatgaagatgtcaaacagagcattcacagaatagaaatgattctgcaccaagtctttcagatgcgccaaatcgccgcttcatttcttgcgggagtccgtgttacgaagttcgaatgggtgacggttatcggaataaaggacgccgccgttactggaatcgccgccggcggattgtgggccgtaaagggaggacttacggcgatgctgtatgatcatctgcgtttcatacataaaccggtgtgcgaagtcattccgtcttttcaagtgcctgcatccaagacgcatttgcagtgtatattcttttttcgttttggacatcttataggtgcagctttcaaattgcttaaatacgggcggaacggactttctatcatacgaaagaaacagccggttccggttgcttcaaagaatgattcatcagtttaaggaggagcgcatatggcagaccatcccattcaaggtttaatgaaaaccgctatggaaaatttaaaagaaatgattgacgtgaatacaatcatcggcgatcctgttgaaacgcctgacggcagcgtaatcttaacggtttcaaaggtcggcttcggatttgcggcgggcggaagcgagtttggaggaaagccggctgaaaaaagaaccgatgatgatgaaagaaaagagcagaagctcccgttcggcggcggaagcggcggcggagtatccattacgccgattgcgtttctgattgtcggaacaaacggcgtgcgcatgcttcatttagacgaaaacacccatctgattgataaactgttagactccgcgcctcaaacgattgaacgcatccagcatatgtttaaaaagaatgaaaaaggccggaaccaaaaaagaacggatatcgatttataacagaaaagttaactgccgcccgcagttagctttttttacgatgcggcataacctttgcagtttgcataaaactcgactatgatagagctatacatagataaagggaggaatcagaatggctgaaattacatttaaaggcggagccgtgacgctgatcggacaagaagtgaaaccgggggaccaagctcctgacttcacggttctgacaaacggattagaagagaagacattagcagatatgaaagggaaagtaacgatcatatccgttattccttccattgacacaggcgtatgtgacgcgcagacacgccgcttcaacgaagaagccgcaaaactcggtgatgtgaacgtttatacaatcagcgccgaccttccgtttgcacaagcgcgctggtgcggagcgaacggaattgataaagttgaaacattatcggatcataaagagatgtcatttggtgaagcattcggtgtttatatcaaagaacttcgtcttttggcacgttccgtattcgtccttgatcaggacggaaaagtcgtttacgcggaatacgtaagtgaagcgacaaaccacccgaattatgaaaagcctatcgaagctgcaaaagcgttaatcaagtaaagagagaaaaagagctccgggtgctgccgcggagctcttttcatggcaaggaggaaacagcatgcaacacgaccatgtcggtcagatttatgaacttttagatgaagccgcccaagtgatagcagaaggccttcagatttcttatattgaggggcttgcggaagcgggagaaatgtattttcttgaaaaggccgaccagcttccgcttcaggaaaagcaaaccggcgagcttaacagcctgcttgcgaaagcagacttcagaaaatgggagcatgaatggatccgcaaggcgttccagctcgccattttaaaagggctgaaagataagtcccatccgaacagacagatgacgcctgatacgatcggcattttcatcagttacctcgtgaataaatttacgggcggccgaaaaggcctgacattgctggaccccgcctgcggcaccggaaatcttctgctgaccgcggcaaaccagctttcggacaaagcggcaaaaagcttcggcattgaaatcgacgatgtccttctgaagatcgcttatgctcaggcgaatctgcaggaaaaagaaatggagctgttctgccaggacagtcttcagccgttatttatcgaaccggccgatgcggtcatctgcgatttgccggtcggctactatccgaatgacgaaggcgctgaagcgtttgagctgaaagcggatgaaggtcactcttttgctcaccacttatttattgagcagagcgtcaaacatacaaaaccgggcggatacttattttttatgattccgaaccatctgtttgacagcgcgcaaagcgataaactgaagcggttttttgcggaaaaagtgtatatcaacgcccttcttcagctgccggctactatgtttaaagacgaagcgcaggcaaagagcattttaatcttgcagaaaaaaggcgaagacgcaaagccgccgaaacaagcgcttttggcgaatcttccttcttttgcgaaccagcaggcgatgcgggagatgacggcaaaattggatcaatggattcaaaaagaaaaataatggcgaaaaagcagtgtgagatgcaaaatcccgcgctgcttttgctttttaaaatgaatggaaatcaggaagataacacaaattaaggaaagaaaataacattccgtaaggccgtgccgtccatttggcacaaatgaaatttatcagaaaatatcgacttcatattgtaagcggtaccaatgtggatgttgacttgaaatgctgagttgacaatgtttaaatggaaaagtcagatattttttggactgcagttatggtctgggaaaaaagaacgaacaaacgaagaagaattttgataggagcgtcatttatgtctaaaattattgcaattaacgcaggaagctcatctttaaaatttcagttattcgaaatgccttcagaaaaggtgctaacaaaaggtttagtagaacggatcggtatcgccgacagcgttttcacaatctctgttaacggcgaaaaaaatacagaagtgacagatattccggatcatgcggttgcggtgaagatgctgcttcacaagctgactgaattcggtattataaaggatttaaatgaaattgacggaatcggccaccgtgtggttcacggcggagaaaaattcagcgattctgttttgcttacggatgaaacaatccgtgagattgaagagatttcagaactagcgccgcttcacaacccggctaacatcgtcggcattaaagcctttaaagaagtgcttccgaatgtgcctgcggttgcagtgtttgatacggcgttccaccaaacgatgcctgaacaatcttacctgtacagcctaccgtacgaatactacgagaaatacggcattcgcaaatacggtttccacggcacatctcataaatacgtgacacagcgcgcagctgagcttctcggccgcccgcttgaagatttgcgtctgatttcctgccacctcggtaacggcgcaagtatcgcggcggtagaaggcggaaaatccattgatacgtcaatgggcttcacaccgcttgcgggtgttgcgatgggaacacgttcaggaaacatcgaccctgcattgattccgtacattatggaaaaaacggatcagacggcagatgaagtattaaatacgttaaataaaaagagcggactgcttggcgtatccggtttctccagcgaccttcgcgatatcgtggaagcttcaaaagaaggaaacgaaagagcggaaacggctcttgaagtgtttgcaagcagaatccataaatacatcggttcttacgctgcgagaatgagcggcgttgacgcgattattttcactgcgggtatcggtgaaaacagcgttgaagtcagagaacgcgtgcttcgcggcttagaattcatgggtgtatattgggatcctgcgctgaacaacgtgcgcggcgaggaagcgtttatcagctaccctcactctcctgtcaaagtcatgatcattccgactgacgaagaggtcatgatcgcacgcgacgttgtccgccttgcacagtaatgatcaaaaaaagcacatccttttagggtgtgcttttttattgaatgccccaggatcaaacgttacgatatgtttaatacataaacgatgaggtgaagcaatgagtgtgcatgaacataaacaagaagccccgtcagccgtgcgctgcaaggtgatcacagtcagcgacacgagaacgaaagaaaccgacaaaagcgggcgcgtcatgatggacttcctcagggaagcgggatttgaaacggtcgcttatgacattgttaaagatgaaaaagatgaattgcagaaagccgttttatccggctgtatggatgaatatacagatgcggtgctgttaaacggagggacgggcattgccgaaagggatgtcacaattgaagcggtcacgccgctgttttcaaaagaacttccgggattcggcgagctgttccgcatgctgagctatacggaggacatcggttccgccgccattttgtccagagcggcagcgggtgtgatccaaaataccgcagtcttctgcacgcccggctcctcaggcgccgtaaagcttgcaatgagtaaactgattattcctgaactgccccatgtgcttcgggaaatccgaaaagatttataaatgtataaaaaggctctgctccgctcaaaaaattgggtggggttttttttataaaaggcttgaaaaaacagaatttacttgttacagtgtatacatacaaaatgcatttttattaattaaaactaatttttatacaaaagggagcttttaacatggcagaacaaaaaaaggttgtattggcatactcaggaggtcttgatacttctgtagcgataaaatggctgcaagaacagggatacgatgttgttgcctgctgcttagacgtaggggaaggaaaggatttggcattcgttcagcaaaaagcgctggaagtaggcgccgtaaattcctatgtgattgatgcgaaagaagaattcgcccgggagtacgcgctcatttctatgcaggcccatacaatgtatgaaggcaagtatccgctcgtatctgcactatcccgtccgttaatcgcgaaaaaactcgttgaagtcgcggaaaaggaaaacgcggtggccgtagcgcacggctgcacgggaaaaggcaacgatcaggtgcgtttcgaagtatccattaaatcattaaatcctgatctggaggtcattgctccggtccgtgagtggcaatggtcgcgtgaagaagaaattgaatatgctgcaagccgtggcataccgattccgatcaatcttgacagcccgtattccatcgaccagaacctatggggacgcgccaatgaatgcggtatattagaagatccgtgggcggcgccgcctgaaggggcatatgacctgacagcatctcttgaaaacacgccggacgttccggaaatcatcgaaatcgcatttgaagccggtgttccgatttcaatcgacggcgtaacctatccgctcgctgatttaattctcaagctgaacgagactgccggaaaacacggcatcggccggattgaccatgtggaaaaccgcctggtcggcattaagtcccgtgaagtttatgagtgcccgggcgccatgactttgattacggctcacaaagagcttgaggatctgactttagtgaaagaagtggcccatttcaaaccggcaattgaacaaaaactgtctgaaatcatctataacggtttatggttctcgccgttaaaagacgcgctgcttgcattcctgaaagaaactcaaaaacacgtcaccggcgtcgtacgcgtcaagctgtttaaaggccatgccattgtagaaggacgtaagtcggaatattcactctatgatgaaaaacttgcgacatatacaaaagacgatgcttttgaccatcacgcggcaatcggtttcattgagctttgggggctgccgacaaaagtaaacagcattgtgaaaaagaaggagcagattgaagcatgaagaagctttggggaggccgttttcaaaaaacaccggaaaagtgggtcgatgagttcggcgcatccatcacgttcgaccaaaacttagtcaaagaggatattacagggtctctcgctcatgcggcaatgctgaaaaaatgcggcattctgacggaagaagaagaaggcgccatccgacaggggctgcagaccctcctgcaaaaagcagaggaaggaacgcttgaattctctgttgattatgaagatatccatttgaatattgaaaaaatgctgatcgaagaaatcggaccgctaggcggcaagctccataccggcagaagccggaatgaccaggtggcgaccgacatgcatttgtatttgaaagatcatgtctcacatatcatcgtgctgattgaacagttccaaaaagcgctgatcgaaaaagcggaggcgaatgtcgagaccattctgccggggtacacccatttgcagcgggctcagccgatttctttcgcccaccatctgcttgcttatttttggatgcttgaacgggataaagagcgttttcgcgacgctatgaagcggattaacatatcgccgctcggatgcggggcgcttgccggaaccacgtttccgatagaccgtaactattcggcggagctgctcggttttgactccatttatgagaacagtcttgacggagtcagtgacagagattttattctcgagtttttaagcggcagcagcatgctgatgatgcacctttcgcgtttatcagaagaaatcattctatggtgctcgcaggaattcaggttcattgaactggatgatacgtatgcgacgggaagcagcatgatgccgcagaagaaaaaccccgacatggctgagctgatccgcggtaaaaccggacgcgtatacggtgatatgatggggcttttcacgattatgaaagggctcccgctcgcttacaacaaagacctgcaggaagataaagaaggcatgtttgacacggtgaaaaccgttgaaggaagccttcagattttcacgggcatgattgaaacgatgaaagtaaacaaagacatcatgaaacaagcgacaaaacaagatttttcaaacgcgacggaacttgccgattatttagctaaaaaaggcatgccgttcagagaagcgcatgaagtggtcggcatgcttgtgtacagctgcattgaaaaaggaatctatttaagtgatatggcatttgaagaattccttcaagccagcagtctctttgaagaagatatctataccgtgctcgatccgcatcatgcagttgaaaaaagaatgagcgccggcggaacgggttttcagcaggtagaacaggcgctcgtaaaagcaaaagcctgcgccggcatttaatttgctgaaatttccttcatattttcccgtcatatcagacaccctacatctataaagatgggaggtagaaggaatgcgcaaagaacaagaccgttacatctatgatgaaaaagaaagtgaagaaacggccaggctcatctcagaggcatacgaaagcggttatgtcggcatggaggaagcctctgctccttcagaaaattaagctgtctgtaaagacggcttttttttcgtgcggacgaagtgcaaaaaagtgatattgccgtttgtttatagtaaagtagagggagaaacgtcttgattttattgaagcggcaacgttgcctggggagggtattcaatgtgcgacatgctctaatcactgccggtacaaagggattgggccgaaaagtaactgaaatgcttctggaaaaaggcttttctgtcacagtgaattacagacaagacgaagaagcggtcgcctgtctgaaggcggattatcccgggtgccatgacagattgcaattcgttaagggcgatgtaacccggaaagaagatcttatgcggatcgccgatgcagcccttcagcggtttggaaggattgacatactgattaacaatgccgggccgtacatatttgagcgcaaaaagcttgccgattactccgatgacgaatggtatgacatgcttgaagggaatttaagcgccgttttccatctgtttaaagcggttatcccggtcatgagacagcagcggttcggccggattattacatacggttttcaaggagcggaccatgcccccggctggcttcaccgttccgctttcggagcggctaaagtcggattggcttcgttaacgaaaaccattgcgattgaagaagctgaatcaggcattacggccaatatggtctgcccgggtgatattgtaggagatatgaaagaagcgtctatagaggaagcaagacggaaaatcggcaaagaaaagacgccgatcggcaggtccggaaccggagaggacattgcgagaatcatcgcctttttatgtgaagatgattccgatcttgtaaccggaacggtcattgaagcaacaggcgggctgaatgtgattaacaggcatcaatccctgtaagttttttcgtttgtcaaaaagggaacttgataaatattaattttttatgaggtgaaaacgatgaaagtgacttatcacggacattctgtcattcaagtggaaacgaaaacccataacattatttttgatccgtttctgaccggaaacagtctgacaaatttgaaaccggaagaagtgaaagcggatgtcatcctgcttactcacggacacaatgaccatgtcggagatacagagcagatcgctaaacaaaacgatgcgctcgttattgcgccgaatgagctggccgtttatctcggctttaaaggtttaaaggtccacccgatgcatatcggaggggcgcgccaatttgatttcggcaaagtgaaactgacacaggcattccacggatcggcggtcactgatgaagaaaacaaaaccattacgtacacggggatgccggctgggattttattgacgattgacggcaaaacgattttccacgccggggacacggcgctgttctctgatatgaaactgatcggggaactgaatcacattgacctggcgtttctaccgatcggtgataacttcaccatgggccctgaagatgcgaaactcgcggctgaatggctgagagcgaaacaggtcgttcccgttcattacaatacatttcctgtcattgaacaggaccctgacgctttcgccgaaagtctgcccggaggcgtcggcaaagtcatggcggtcggcgagaccattgagcttgcctgacatatgtgtcaaagaccttctgaatcaagcattcagaaggtctttttgtgatgccgccttttttcgggcgtctcattgcgaatgaatcccccgtacccttataataaaagcagaagactgtccttagaggtgaaacgcttggcaacaaagcatgaacaaatcctatcatacatagattcgcttcctgtcggtgaaaaaatttcggtcagaagaattgcgaaagaaatgaaagtcagtgaaggaacggcttacagagccattaaggaagccgagaacaaaggattcgtttccactattgaacgtgtggggaccatccggattgaacagaagaaaaaagaaaatattgaaaagctgacatacgccgaggtcgtcaatgtgatagacggccaggtgctcggcggaaaagccggtctgcataaaacgttgaataagtttgtgatcggcgcgatggagcttgacgcgatgatgcgttatacggcggcggggaacctgttaatcgtcgggaaccgaatcaacgcccaccgccaggcgcttgaagcgggcgcggctgttttggtaacgggagggtttaataccgacgacagcattatcgagctggccgatatgcttgagcttccgattctctccacgagttacgatacctttacggtagccgcgatgatcaaccgggcgatctatgatcagctcataaaaaaagagattgtgctcgtggaagacattttgacgcccgcagatcggacagtgacgctgtcccctaaggataagctggagaaatggtacgaaaagaactatgaaaccggacacggccgcttcccggttatcgaccagcagatgaaaatccacggaatcctcacatcgaaagatatcgcggggcatgaccggtcagttccgattgaaaaagtaatgaccaaaaaccctgtcacggtgatcgggaaaacatctgtcgcctcagctgctcaaatgatggtttgggaaggaattgaagtgcttccggtgacagacgggcatcacaaactgatcggaatgatcagccgccaggatgtcttaaaagcgcttcaaatggttcaaaagcagcctcaggtcggggaaaagctggatgatattgtttcaaggggatttaaagaagacgaagatgacaaaacgccggccgtttatcaatatgaagtcacgccgcaaatgaccaatcagctcggcacgatttcttacggggtgtttacgacgattttaacccaggccgccagccgatttttacgctcccgcaaacgcggcgagctggtcattgaaagcattacgattttcttcctgaagcccgtacagatggagtcggtcattgaagtgaaaccgcgcattttagaggcgggccggaaattcgggaaaatggaagtggaagtgtcaagccaaagcggcatcgtttcaaaagcgatgctcatggtgcagctgatggagagaagttaagggacgcacccgggtcccttggcattcattatgcgtggtccctctccgcttcctttgcatggatgggctcataatgcttataggctttatacccggcccatgcgctgcctgctccgattaaaatgaagacgccgccgatgaccagggtcaggacggagtgaaacagaatcatttggtttactccgtacaaaagcaccagcgcgcctaatgccatacttgatttagccgaaaaacattccttctccagcgcccgtttcgtctggattccttttactttgtaatacacgtaaaagcaggcagaaagcccgatgagaaaaacaaaaaccagcataaatgaaatcctccattatatgagtttgcaaaaccgtttataccgttgctgaaagattttccttttccatggataaagagtatgattaaatgaataaaaacgaaaaggagaaagcgatgaaatccgaactgatcagaaccatatcattatatgacaccattatcttacatagacatgtgaggcctgacccggacgcctacggttcacagtgcggccttacggaaatcctgcgggaaacgtatcccgaaaaaaatatttttgccgtcggacagcctgagccgtccttgtcttttttatattccctcgatgaggtggatgacgaaacctataaagatgctcttgtcatcgtgtgcgacaccgcaaaccaaggcagggtcgacgatcagcgctaccattccggcgcaaagctcatgaaaatagaccaccatccaaatgaagatccgtatggcgatctgttatgggtcgatacgaatgcaagctccgtaagcgaaatgatctatgagctgtacctggaaggaaagcagcacggctggaaactgaatacgaaagcagctgagctgatctacgcgggtatcgtcggtgatacggggcgcttcttattcccgaacaccacaaaaaagacattaaaatacgcgggagagctcattgagttcccattttcatcgtcagagctgttcaatcaattgtatgaaacaaaattaaatgtggtgaagcttaacggctttatttatcaaaatgtgtcactgtctgaaaacggcgtcgcttccgtgttcattaaaaaagacattttggagacatatggaaccaccgcttctgaagcgtcgcagcttgtcggaacactcggaaatatttcgggtatccgcgcttgggtgtttttcgtagaagaagacgatcaaatcagagtccggttccgttcaaaaggtccggtcatcaacggaattgcccggaaatacaatggcggcggacatccgcttgcggccggcgcatccatcttcagctgggatgaaaccgatcagattcttgctgatctggaagaggtatgtaacgaacacaagtagaggggagaccctctttcttagtgttcatctgtcacggggatgaaccagcagccgaaatcagtcaggtcttcgtagacgcggagattacagatttggagttctttttttatgagggaagcgagtgtgtctgtttctgcatatgcggaatagccttgtctgattcgggctgcatgatcttttgccaagcgtcgttcactaaaaacctccattttcccttcctcccttcagaatcattgaaaatgtctcatttacagtttataaaaaagcggagaaaaaagcgacagatctatggaaaatttttaaaaatgacataattacgtcgcaaaagaaatatgaatttcgacagacaatctcgtataaatcgtcagttcctttacttcagctttaaattccttctcatttatggtgtatattttgttttcgatcgtccgttttaaaagctcctttgttttatacacgctttcaatatcttttgtgatgacttcagaaatattatctttcacttgttcctcaaatttcatcttgtcaggctgggcgattctgtatttttccccattgatcagcttcacatcaacactttggatgagaagtctttgcttattatcctcatttaatttatgaagatccttctgatagatggagatttggttttttaaatcccgcgcgtgctcacgctgcttttcaattaacgtcacttgttcttcctgaaacgttccgtatgtaaacagaaagaacagccagctgacgatggctccgcacatcattcccgcgaaaaaacgctgccatcccggttttttataatactcgggaattctcatgatgacatattctcctgggtcagccatgaaatgatcagccagccggtctgcgcgccgcccattgctgaaataattaaaagaagctgtttgaagatgtcgcgcgtgttgccttcgaacagcccccgctcgaaactgtataccgcgtcaaatgttcccccgatggccgcgacaagcgcccagatcttcagcctgttcgccaattttgtgatcgccgtcagcggaggctcgcctgataaataagctccgaggccgccgatcagcgcgccgccgagcaacacaccgagggcgataaaataactgctgatgaaattcgccataaatccggcttcctgatccatatatacaccacctcacttttctatcatattgagcgaaacggacaagtatgatgatgagtcaaaaaagaacatttgtttcttaagaaaacccgtcttataatgtagaaaggcaaaatgaacgtatgggaaaggagtggcggcattgtcttttgttcacctgcaagtacatagcggctacagtctgttaaacagcgccgcttctgtaaaagagcttgttacacaagcgaaggaactcggatattcatcattggcgctgacggacgaaaatgtgatgtacggcgccattgagttttataaagcatgcaaatcaaacggaatgaagccgattatcggtctgacggcttctatatacacggacgatacggagcttgaagcacatccgctcattcttttagcagagacaaacatcggatatcagaacctggtgaaaatctcaagtgcgctgcaatccatggcaaagggcggcatgaagcgaaaatggatgaagagctatcatgaggggctgatcgccattacgcccggtgaaaatggctacattgaaagcctgcttcaagccgggaagtttgaagaagcggtccgggctgccgaaggattccgggagctgttcggagacggccgtttttatttagggtatcagccgtttaaaggacatgagacgttatcagaagagattctccgtctgtcagccgagacggaaatcgctgtctgcgctgcgggggatgtccgttatatcaagaaagaagatcaagatgcgtaccgctgtctgtgcgctattaaagccggagagaagtgggaggatcagagcgggaatctgccggacttatacttgagggcgcctgaagaaatggcagagctttacacgcggcatccggaagcgattgaagcagccgcgcgtatcgcccggcaatgccgggtcgatgtcagcctcggacagacacagcttccgtcttttccggcgccggacggcaaatcagccgatgactatttggcggagatctgtcatgaggggctgcgcctccgtttcggcactcctgatgagcgcgctgtccgccggcttgaatatgagctggacgtcatcaggcgcatgaaattcagtgattattttctcatcgtatgggactttatgaagtacgcgcatgaaaagggcattgtgacaggcccgggaagggggtccgcggcaggctcgcttgtcgcttactcccttttcattaccgacgtggatccgcttaaacattctctgctgtttgagagatttcttaatcacgagcggatcagcatgccggatattgatatcgatttccctgacacgagaagggatgaggtcattcagtatgtacaaaataagtacggggccatgcacgtcgcccagattatcaccttcgggacattggccgcaaaggcggcgttaagggataccgggagagtgttcggaatcagcccgaaagaagccgaccagcttgcccgcctgattccgtcaaaaccgggaatgacgcttgatgaagcgaggcggcagtccgctcagctgaacaggaggctgtccgaatccgccgttcttcataaagtgtttcagatcgcaaggaaaattgaaggtcttccgcggcacacgtcaacacacgcggcgggggtcgttctcagtaaagagccgctttctgaagttgtccctcttcaagaagggcatgacggcgtgtatttaacgcagtatgcgatggatcacttggaagatctcggtcttttaaaaatggactttttaggtttgcgcaacttgacgcttattgaatccattaaaacgatgattgaaaaagagacgaatacgaaaattgatttttccgagatttcttatcaggatgaaaaaacgttctcgctattgtcaaacggtgatacgacgggtattttccagctggaatcatcaggaatgagaaacgtgctgaagcgcctgaagccgtcaagactggaagacattgtcgcggttaacgcgctttacaggccgggaccgatggaaaatattccgttatttatcgaccggaagcacgggcgggcgcgtgtggaagtgccgcacgaggacgtacgaaatattctcagtgacacttacggcgtcatcgtctatcaagagcagataatgatgatcgcctcgcgcatggcagggttttcattaggtgaagcggatctgctcagacgggctgtcagcaaaaagcaaaaggacattctggacagagagcgaagccattttgttgaagggtgcttaaaaaaggagtattctgtagtcactgcaaacgaggtctacgatctgattgtaaaattcgctaactacggattcaacagaagccatgctgtcgcatacagcatgatcggctatcagctcgcctatttaaaagcgcattatccgttatattttatgtgcgggctgttgacgagcgtcatcggcaatgaggacaaaatatcgcaatatctgcatgaagcgaaggggagcgggattcaagtccttccgccgtcaataaacaaaagcggttttccgtttgcgccggaaaacggagccgtcagatacagtttgcgggccgttaaaaacgtaggcgtctcggcagtgaaagatatttataaagcaagaacacataaaccgttcgaggatcttttcgatttctgctttcgcgtacctgcaaaaagcgtgaatcggaaaaccatcgaagcccttatattttctggcgccatggacgaattcaatcaaaatcgcgccgccttgctggcctccgttgatgtggctttagagcacgctgaactttttcgtgcagacgatgaccaaatgggattgtttttggaagaatcgttctccattaagccaaaatatgtagaggctgaggaatttccgctcgtggacaagcttcggttcgaaaaagaagctctcggtgtttatttctcgagccatcctttatctgctttcagggatctcctgaaaaaacggggggcgcaagcgatcacagcagcgcggcagatgccgaaggggcagctgtcaatcggcgctttgctcgcgggcatcaaaacgattcggacaaagacaggtcagcatatggcgtttctcacattaagcgatgaaacgggagaaatggaagccgtcgtgtttcctgaccaatatagaaggctgtctccgctgttaaaggaaggcgcgctattattcgccgccggaaaaatggaagagcgtcaggagaagacacaattcatcatgtcatccgcctctcttcttgagcagacggaggcagacagagcgccgtctgtttacatcaaaatcgaaggcagccggcacaatcaggagtttttggaaaagatgaagcgtattttactggagcataaaggggaaaccggcgtttatctatattatgaaaaagacaagcagacgatcaggctgccggatacttttcatattcaggcggaccatcaggcgttataccgtttaaaagagctgctgggccgcgaaaacgtcgtgttaaaatagtggtaacaataatcgttttgttatacaattgaaacaattgtgctatcttatttaaagattctgaaatttttcacctccagcgattgtaccagtctatgcggcagaatatgtaacaaagtacttaaaaggagtgtttagaatgtcattaagagaagaagcgttacatttacacaaagtaaatcaaggaaagctggaatcaaaagcaaaggtagaagtcagaaacgcagacgacttaagccttgcatactctcccggagtagctgagccttgtaaagagatttatgacgataaaaacaaagtatatgattatacaatgaaggggaacatggtagcagtcgtaacagacggatcagccgttctcggactcggtaatatcgggcctgaagcttcacttccggtcatggaagggaaagcggtgctgttcaaaagtttcgcgggcgtggatgcattcccgatcgcgcttgacacaaacgatgtggacaaaatcattgacactgtgaagctgcttgcaccgacattcggcggagtcaaccttgaagatattgcggcgccgaactgcttcattatcgaagagcgcctgaaaaaagaaacaaacattccggttttccacgatgatcagcacggcactgccatcgtaaccgttgccggacttgtaaacgcgctgaaattatcaggaaaatccatgtcatccattaaagttgtggcaaacggagcgggagcggcaggcatcgcgatcatcaagcttctttaccatttcggcgtacgcaacatcgtaatgtgcgactctaaaggggcgatttacgaagggcgtccggccggcatgaacgcagtgaaaaacgaagtggcgaagtttacaaaccaagaccgcaacgacggttcgctgcaggatgtcattaaagatgcagacgtctttatcggcgtatcagtcgaaggcgcgctgacgaaagaaatggtggaaagcatggcgaaagatccgattatcttcgcaatggccaacccgaatccggaaatcatgcctgaagacgcgcgcgcagccggcgcaagcgtaatcggaacaggccgttctgatttcccgaaccaggtcaacaatgttctggcattccctggaattttccgcggggcgcttgacgttcgcgcgactcacatcaacgaagaaatgaaaattgctgcggttgaagcgattgcttcccttgtttcagaggaagaattaagcgctgattatgtcatcccggctccatttgacaaacgtgtggctcctgccgttgcgaaagctgttgcgaaagcagcgatggaaacgggcgtcgccagaattacggtcgatcctgaggaagtggctgaaaaaacaagacagctcacggttatcggcgaataataacacaaaaatgaaatggcagcgcgttggaaaaaaacaacgcgctgctgttcaatatacggactgctggcatttttttaagggcaggtcttaaaaaaatttcagcagaatccttatttcttttgaaaacgctgacagataaggctgaacaacgctttttacggtatgaaatccgtccgtttccgtctgttttgcagcaaaaaatgtcgaatggaggatgacaccgtttgacaaaaaaagtacaatagtttcggtaaagttattattaagtctatctaatcggaagacatgcagtgaagagaacccttcacaaaagggaggtaatcatttgttaaaggatatattcacaaaaaagaaaaaatatgcttccgtgccgtctgagcaggcaaaacatgatgttccggaaggcattatgacaaagtgccccaaatgtaaaaaaatcatgctcacaaaagagttagataaaaacctgcgcgtctgcatgaactgcgggcaccatttcccgatgaatgcaaagcagcgcattgaaagcctcctggatgaagattcattcgaagaattcaaccagggaatgatatctgaaaacccgctcggtttcccggaatacttagaaaaaatcgaaaaagaccgtgagaaaacatcgctgaatgaagcggtggttaccggaaaaggaaccatcagcggattcccggccgtgatcgcgatcatggattcaacattccgaatgggcagcatgggttcggttgtcggcgaaaaaatcacgcttgcaattgaaaaagcaaaagaggaaaaagtcccgtttatcatctttaccgcttcaggcggcgcacgtatgcaggagggggtcttaagccttatgcaaatggccaagacaagctctgcattaaaactgttcagtgaggagcagggactgattatttctgtcatgacccatccgacgacaggcggcgtatcggccagtttcgcgtctctcggtgattataatttcgctgaaccgggcgccttgatcggatttgccggaagacgtattattgaacagacgatcggggaaaaactgccggaagatttccagacggcggaatttttattaaagcacggccagcttgatgcggtgattcaccgaaacgacatgaaagacaaactcgcatttctgctggacatgcaccaaacaggaggtgagcatgagtggctgcaagattagaatttgaaaaaccagtgattgaactgcagacgaaaatcgccgaactgaaaaaattcacccaagattcggagatggatttaagcgctgaaatcgcaaggcttgaagaccggctcagcaagcttcaggatgagatttataaaaacctgaagccgtgggacagagtgcagatcgcacgccttcccgaccggccgacgacgcttgattacattcaatacctgtttaccgacttttttgagtgccacggagacagaacatacggagatgatgcggcgattgtcggcggagtcgccaaatatcacggcatgccggtcaccgttatcggacatcagcgcggaaaagacacgaaagaaaaccttgtccgcaatttcgggatgcctcaccctgagggctaccgcaaagcgcttcgtctcatgaagcaggcggataagttcaaccgcccgattatctgcttcatcgacacgaagggagcgtacccgggtaaagcggcggaggaacggggacaaagtgaagccatcgccaagaacctgttcgagatggccggcctgaaagtgcctgtcgtttgtatcgtcatcggggaaggcggcagcggaggcgcgcttgcgttaggtgtgggcaaccgcatgctgatgcttgagaactcgacgtattccgttatttctcctgaaggagccgcatccattttgtggaaagactccagccttgcgaaaaaagcggccgaaaccatgaagattactgcgcccgatttattagaattaggaattattgatgatatgattaaagaagtgaagggcggagctcaccatgatatcaagcagcaggcgggctacattgacggtatacttaaagaaacgttaaaatctcttcttcaattgaacgccgaagaattgatctcacagcgatatgaaaaatataaagcaatcgggaaagtttcggttgaggatcaatatatcggggtaaactgaatagacgtgaagcctatggctcacgtttattttttgtgatttttgtgatattccttaaattttatttaaaaacaatttatttaattgtataataggtaaggtttcatgggagctcaggcgtcccttttcattgttttagggcaatgatcatgatatgtttaacatatatatgttgctgaggtgaataggaaatgaagcgtataggagttttaacgagcggcggggattccccgggtatgaacgctgcggtgcgcgcggttgtgcggaaagctatctaccacgacgtcgaagtgtacggaatttataacggttattcaggattaatcagcggtaaaatagagaaactggagcttggttcggtcggtgacatcatccaccgcggcggaacaaagctgtacacggccagatgtcctgaattcaaaacagttgaaggccgtgaaaaaggaatcgaaaatttaaagaaactcggcattgaaggtcttgtcgtcatcggcggagacggttcatacatgggtgcgaaaaaattaacggaacacgggtttccgtgtgtgggtgtaccgggtacgatagataatgacatcccgggaactgattttacgatcggatttgatacggcgctaaacaccgtaattgatgcgattgataaaatccgtgacaccgctacgtctcatgagcgtacatacgttattgaagtgatggggcgccatgcgggcgacattgctttatgggcaggtcttgcaggcggagcggaatcaattttaattcctgaagcggactacgatatgcaggaaattatcggccgtttgaagagagggcacgaccgcggcaaaaaacacagtatcatcatcgttgcagaaggggtaggcagcggggttgaattcggaaaacgcatcgaagaagaaacgaaccttgaaacacgggtatccgttttagggcacatccagcgcggcggatctccaagcgcttctgaccgggttcttgcaagccgcctcggcgcttacgcggttgagcttctgcttaaaggaaaaggcggacgctgcgtaggtatacaaaacaacaagcttgtagaccatgatattatagaaattttagaatcaaaacatactgttgaaccaaacatgtatcagctttcaaaagaactgtctatttaaggcggaagaagctgaagatttcagaaggaagtgaacgagttgaaaaaaacaaaaatcgtttgtacaatcggtccggccagtgaaagtgtagaaatgctgacaaaattgatggaagcgggtatgaacgttgctcgtctgaatttttcacacggtgatttcgaagagcacggcgcaagaatcaaaaacatcagagaagcaagcaaaaagctcggcaaaaacgtggggattctcctcgatacgaaaggtccggaaatccgcacgcacgatatggaaaacggcgcgcttgagcttcaggcgggaaatgaaattatcgtttctacgaaacaggtgctgggaacgcttgaaaaattctcagtttcttatgaaggcctggcagacgacgtgtcagcagggtctatcatcctgttggatgacggtttaatcggattggaagtgctagaatcaaatccggaaaaacacgaaatcaaaacaaaaatcttaaacagcggcacgctgaaaaataaaaaaggcgtaaacgttcccggcgtcagcgtcaaccttcccggaattactgaaaaagacgccaaagacatcgtattcggtatcgagcaaggcgttgatttcatcgctgcgtcatttgtacgccgttctacggatgtccttgaaatccgcgaactgcttgaagagcataacgcgtctgacattcaaatcattcctaagatcgagaaccaggaaggcgtggacaacctggacgcgatcctggaagtatctgacggcttaatggtagcgcgcggagacctcggcgtagagattccggccgaagaagtgccgctcgtgcaaaaagaaatgatcaaaaaatgcaacgcgctcggcaaaccggttattactgcgacacaaatgcttgacagcatgcagcgcaaccctcgtccgacacgcgctgaagcaagtgacgttgccaacgccattttcgacggcacagacgctatcatgctttccggtgagacggctgcgggacaatatcctgtcgaggcggttcaaacaatgtttaacatcgccacacgcacggaagaatctctgaactacaaagaaattctgtctaaacgcagagatcaggtcggcatgacgattaccgatgcgatcggccaatcagttgcgcacacggcgatcaatctgagtgcggcagctatcgttacccctacagaaagcggccatacggcgcgtatgatcgcgaaataccgtccgcaggctccgattgtagccgttacggttaatgagtctgtatcacgcaaactcggtcttgtattcggtgtattcccggcaagcggccaaaacgcgaattcaaccgatgaaatgcttgaagacgcggttcaaaaatcacttgacagcggcatcgtgaaacgcggtgatctgattgtcattacagcaggttctgtcggtgaatcaggcacgacgaatctgatgaaagtccacactgtcggcagcgttatcgcgaaagggcaaggcatcggacgcaaatctgcattcggtccggtcgttgttgcaaaaaatgcgaaagaagctgaacaaaaaatgacagacggcgcagtattggttgcttcaagcactgaccgcgacatgatcgcttcacttgaaaaagcatcagcgctcatcactgaagaaggcggtctgacaagccatgcagccgttgtcggtttaagcttgggcattccggttatcgtcggtctggagaacgcaacttcagttttaacagaaggacaggttatcacagttgacgctgcccgcggcgctgtgtatgaaggccgcgcaagcgttctttaaacagctttaaaaaagagaggggggttctcccttctcttttgtctttaggtttattttcctattcccatgcgggcggtgacgcgcttttagaagggcaggagggcagaaaaatgagagtgttattcttactgtttatcgtgtgtccggcaattgaaatcggtttgtttctgctggcgggaaaatggctcggtatttttccgaccttccttctcatcattttgacaggcgtgttaggcgccttggtggcaaaaagacagggaaccgatgtgtatcatcgggtgatgcgcgacctgcagcacggcaaaatgccgggggaagcgcttcttgacggaatatgcgtctttttcggaggcctgcttttgatgcttccgggttttctttccgatattgcaggggcctgtcttctgattccgttcactcggaaccgcatgaagccgcttttgttcaaatggctgagaggaatgtcaaaaaacaagcggatcattatcaaataaaaacggcagccttcttacagggctgctgtttttatttggactgaacagtaatataggcccatatttcttttaaagcgcccgttgtgataaaggcctgaatgaaaacgagcagcgcgggccccgcagccagtcctaaaattccgaacaatttaaagccggcaaacagagcgattaaggtcgcaagcggatcaagtccgattgacttgcttaaaattttcggctccgtcagctggcgctggataagaaccacaatatataaaacaccgagaccgatcgcttgaggaagctgaccggcaatggccaaatacataatccagggaacaaagaccgatccggcgccgagatacgggagcaggtccaccaggccgataaaaaaggcgatggttgccgcatgctcaatccctaaaagaaaaagtccgataaagacaatgatcatcgtgaaaagtatgagcacggcctgcgccttaatgaaacctgccatcgcttttttcagctctcccgatacggccttggcgtttgccgaaacccgttccggaagaatggaataaagcagcgccttcagcttatgccagtcctttgtcataaaaaaagtcgccagcattgcgaaaatgaagacggcagctgtattgggaaggaaggcaatccatttcggcaccagctccaaaagatgtgaaagcatcagccccgcatttttagcggctgtatcaccgagggtctgaatatgcgtcacgatggatgcctgctgattggtttcaagcccgttaaataagacggtcagctcgtggtacaatggctgaatgcgggaagtgaacagctcttcgcaatacgtcataaaggcgctgatatggggagggagcgttttggccagataggcggttcccgaaatgatttccgcaacgagaaatgtcgccgcgccgagaagaataagcaaaaagaagaccaggacaatgactgtattgactgaccggggcagccccgtcagtttgtccagccagtcaacaacgggaatgatcgctgatgacagaataagggcgatcagaaacggataagttaacggaaatgaggcgtaaccggccgctaaagcgccgccggccgcagcgagtacaaacagcgcgcggaaaaaaacagttgcatagtgcggattcacatcgatcctcctctcgatggcacgtcctattacattagtttattcgtcaaaaaaaaggatatgaatacagatatgatgaaagagggtgctttcaggatgtttacacaagcgaatttatttttactattattgctggccatcgcattgatagccaaaaatcagtcattgctttttgccgtcggctttctcattgtgataaaagctgtcggtcttgatcagaaactatttccggttattcagtcaaaaggcatcaactggggggtcaccgtcattacaatcgccgttttagtgccgattgccacaggtgatatcggttttaaacagctcggagaagcgatgaaatcatattatgcgtggatcgctctcggtgccgggatcgcggttgccttaatcgccaaaaacggtctcaccttattggaaaacgaccctcatattacaacggcgctggtcatcggcacgatacttgccgtcgcgcttttcggaggcgtcgccgtaggcccgttaatcggcgccggaatcgcctacttggccatgcaaatcgttaaaatattcacttcgtaaagtaaaaaagcggcgtaaagctgctttttttgtggagaaaattagagtttgcacttgcgcattttgtagttcagacaaatgccatttacattattccgatgaatgaagcggcttaccatgtaacaaagagcttcgggattgacggcgcacatggagcgaaaacagcgattgcagtagattaaaagctgatgggatttatgggcctgataccaaagcaaaacttgaagtgttgttaaaataagcggagaccctttccttcaatttgaaagtttgttaaatttataatgagaatgaaaaaacacaattcggttggtagtccggatgcatgatttaaaatgtcagtaaccttcccctcctcgggatgtccatcattcttcagtaaatttaggaggagggaatcgttatgaaattaacggtttactacgatggtcagttttgggtaggagtcattgaagttgtgaatgacgggaaattaagagcaattcgtcatttgtttggacaagagccaaaggattcagaaataatgcattttgttaataatcaacttttacagactctctcccacactgaacaagaaggggtttgtgttaaagcaaaatctaagaaattaaacccaaaaagattgcaacgacaagcttctaaagaaatgaaaaatatcgggatatcaactaaggcacaaaaagcgataaaacaggagcttgaagcaagaaaagaaaagaaaaaacaactgaacagaaaacaaagagaaaaaataaaggaacaaaaatatttaatcagaaaacaaaaagcaaaagaaaagcataggggaaaatagttggagagcccgatgaagcccttcgattgaaaagttgagcggcatcagttagtttcttcggactgatttagagaaaaagaagtataagtcagagctcttctcgagatgaggagggtttttctgccatttatttaacttcacttacatcagtaaatgagtcagtttcaattgatgaacggtttgataaggatatttacgggctgactgcaaaagcgaaaatcttgtcttagctgaagtaataataaactctctatttttatgaagggagatgattaatttgaaaaaataattgtattgttgatcttatgtttttcgttaagctctatcacagtggctgctgctaaacaagaacatcgccagaacccaaaagattctcaagagctatttgatgtttttatgcaagaacttttatgtaaagatatattagacaatgtccgtaaattctataaggctgccactaagagactttaatgggaaggctttatattatagcaaggacaatattttcgtctttgtctttggcccataaatgccatcagcagtcaggccgtacatggactggaatcgtttgactgctttgctgttttcgggccgatgaaattgagaactctgtcccattcatattattcactttcctaagaaggggattaaatttgcggtgaagttgtcgcgcctgtccttttaaagtctcctccaaaacacccccaaatgaaaacatgagaatacatggttttacaaagcgcctgaaagcaagcgattaaatttatcaacgcaaaaccttgatatatagggcttttaaaacatttttagttaaaagtctacaaattaatcagattattgtttataataagaataggcttaaacttaaataagcttataagaatttgttatgttcctctataagcatatcggttatgtaaccgcaatcagtgaaatgtaagcattttcttaaaggggaaagggattgtttgcatgactcattttaagtaagccgtatgttttatatactctttaaaggggaattttgattgaaaaggagaggttgaatatgacagcaacacgcggtcttgaaggggttgtagcaacaacatcatctgtaagctctattatcgacgatacccttacatatgtagggtacgatattgacgacttgacagagaatgcaagttttgaagaaatcatttatttgctgtggcatctgcgcctgccgaataaaacggaacttgctgaactgaaaaaacagcttgcgaaagaagctgccgttccacaagaaatcattgagcacttcaaatcatatcccctcaataacgtacatccaatggctgcgctccggacggcgatttcattactcggtctgactgacagtgaagccgatgttatgaatccggaagcgaactacagaaaagccatccgtctgcaggcgaaagtgccgggcattgtcgccgctttctcaagaatccgcaaaggacttgatcctgttgaaccgaaggaagagtacggaatcgcggagaacttcctttacaccttaaacggtgaagagccttctccgatcgaagtggaagcgtttaacaaagcgctcattcttcatgcggatcatgagctgaacgcatcaacatttacggcgagagtatgtgtcgccaccttatctgatatttactcaggcatcactgccgccatcggcgctttaaaaggaccgcttcacggcggagccaatgaagccgtcatgaaaatgctgacagaaatcggcgaagtggaaaacgccgagccttatatccgcagcaaaatggagaaaaaggaaaaagtaatgggcttcggacaccgtgtgtataagcatggagacccgcgcgccaaacacttaaaagaaatgagcaaacgcctgacgaatctgacgggggaaagcaaatggtatgagatgtcaatccgtgtcgaagaaatcgtgacgtcggagaaaaaactcccgcctaacgttgatttctattccgcatctgtataccacagtctcggcattgatcacgatctgttcacgccgatctttgcggtcagcagaatgtcaggatggatcgcccatattcttgaacagtacgataacaaccgcctcatccgcccgcgcgctgattacacgggtccggataagcagacttttgttccgattgatgaaagagcctgatcaaacgggaggctggtgattttcatgtcgttagcctcttgttaatcaagcccggattggtttacaattttgatagaatcttgagaaaagtcattttattttctatacaagaaaaataaaatgttttctaaatatgaattacatactgggaggtaatattgtgtcacaaggtgaaaaaattacagtctctaatggagtattaaacgtaccaaataatccgattatcccgtttattgaaggcgacggcacaggccctgatatttggaacgccgcttctaaagtattggaagccgctgttgaaaaagcatataaaggcgagaaaaaaatcacgtggaaagaagtttatgccggtgaaaaggcttataataaaacaggtgagtggcttcctgccgaaacgctggaagacatcagagagtacttcatcgccatcaaaggtcctctgacgacaccggtcggcggcggtatccgttctctgaacgtggcgctgagacaggagcttgatttgtttacgtgcctgcgccctgtcagatatttcacgggagtgccttctccggtcaaacgacctgaagatacggatatggtcattttccgcgagaatacggaagatatttatgccggaattgagtatgcgaaaggttctgaagaggttgaaaagctgatcagcttcctgcaaaatgaaatgggtgttaacaaaatccgtttccctgaaacgtcaggaatcggcatcaaacctgtttctgaagaaggcacaagccgcttagtcagagctgccattgagtatgcgatcgaaaacggccgtaagtctgtcacgcttgtccacaaaggaaacatcatgaagttcactgaaggggcatttaaaaactggggctacgagcttgccgaaagagaatacggagataaagtattcacttgggctgaatatgaccgcattgtcgaaaaagacggaaaagaagctgctgataaagcgcagagcgacgcggaagcggcaggaaaaatcatcgtcaaagacagcatcgctgatattttccttcagcagatcttaacccgtccgagcgaattcgacgtcgtggcgacaatgaacttaaacggagactatatctctgatgcgcttgccgctcaggtaggcggaatcggaatcgcgccgggagcgaacatcaactatgaaacagggcatgcgattttcgaagcgactcacggaacggctccaaagtatgccggccttgacaaagtcaacccgtcatccgtcatcctttcaggagtgcttcttcttgaacacctgaactggaatgaggctgctgacttgatcattaaatctatggaaaaaacgattgcttcaaaagtagtaacgtacgattttgctagattaatggacggcgcaactgaagtgaaatgttcagagtttggtgaagagctaattaaaaacatggactgaacctaaagcagacttctaatgaagccaaaaaaggagaagagaatcatgggaaaaacacgcagtaaagtttctgttatcggagcaggatttacgggagcgacaacagcctttctgacagctcaaaaagagcttgcggacgttgtgctcgttgatattccgcaattagaaaacccgacaaaaggaaaagcgctagacatgctcgaagcaagtccggtccaaggatttgacgcgaaaatcacaggcacgtccaactacgaggacacagccggttctgatatcgtcgtcatcacagccggaattgcgagaaaaccgggcatgagccgtgatgatctcgtatctacaaacgaaaaaatcatgagaagcgtcacacgtgagatcgtgaaatattctcctgactgcattatcgttgtattgacaaaccctgttgatgcgatgacatatgcggtgtacaaagaatcaggcttcccgaaagaacgcgtcatcggacaatccggagtgcttgacactgcacgattcagaacattcgtcgctgaagaattaaacctgtctgtaaaagatgtgaccggttttgttcttggcggacacggtgacgacatggttcctctcgtccgttattcctatgcgggcggcattccgcttgaaacgcttatcccgaaagaccgtcttgatgcgattgtagaacgtacaagaaaaggcggcggggaaatcgtcaaccttctcggcaacggaagcgcctactacgcgcctgctgcatcactgactgaaatggtagaagccattttgaaagatcagcgccgcgtgcttccgaccatcgcttacttagaaggcgaatacggtcatgaaggcatttacttaggcgtaccgacgattatcggaggaaacggcctagagcaaatcatcgagcttgaactgacagactatgaaaaagcgcagctgagtaaatcagttgaatctgtcaaaaatgtgatgaaagtattgtcataagaaaaaagggaaggcttccgaatcagaagccttcctctttttacaattaatgaaagcgttttctttttccctgagcgatcctttctctgaaaatgatcaaaaaggcgaattgtctgaacgggcagtattggataaaatgaaatcataaagtgatatgcagcacataaaatagagaaaattggatgtcggggaaaatagacagcggagggcgcagcatgaacaaaaaaattttagttgtagatgatgaacaatctatcgttactcttttacagtataatctggaacggtccggctatgatgtcattaccgcatcagacggagaagaggctctggagctggcagagaatgaaaatccggatttaatcgtactggatgtcatgctgccgaaagtggacggaatcgacgtctgtaagcagctcagacagcagaaaatgatggtcccgatcttgatgctgacagcaaaagatgaggagtttgataaagtgctgggactggagctcggagcggatgattacatgacaaagccgttcagtccgcgggaagtcactgcgcgggtgaaagccattttaagaagggctgacatttcttcgctgtcacaaggcagagaagaggaaaaggacgggcagatcctcatcggcgagctgaaaattcttccggagcattacgaagcgtacttcaagtcagaacagctggaattgacgcctaaagaatttgaactgcttctgtatttgggaaaacataagggaagagtgctgacgagagatcttctgctgagcgcggtctggaactatgattttgccggggatacccggattgttgacgttcatatcagtcatctgcgcgacaaaatcgaatcaaataccaaaaaacccatctatattaaaacaatcagaggtttggggtataaactggaggagccaaaaatgaatgaataaagtccgtgtgcgtctgttcgctttactcgttgtatgtatcatattggttttcagtgttctcggcctttttttacagcagcttatttcttcatccgctgaagaaagaacggcggatcagctgaaaaaggaatcggtatacatagcgggccttcttgacaccggccgaatcggcaataaaagcaatgaaacggtaatccgtgacgccggccgcaccctcggtataaacgtcgccgtgctcaatgagaagggtgacgccgtatatcattccggcagtcatgctgatgattcagccgtaaaggagttcatttctcacaataaaagcgaggaagccgtacagtcgaaaagcaaagtcatccgcggcactgccgtaaaaaatgacgccgggaaaattgcggggtatgtactcgtttcctctgagatcaacggcggttcaagcgttaccggagaaatgtggggcatgctggcagcaagtctttgtaccgcttttatcattatcgttttcttttatacaaacatgacgtcccgttacaaaaaatcaatcgacgccgcgacaaaagtggcgacggagctgtccaaggggaattatgacgcccgctcctacagcggttacgcaaggcggtcggaccgtctcgggcgtgcgatgaacagcctggcggtcgatttaatggaaatgacgagaacgcaggatatgcagcgcgatcgtctgttaaccgtcattgaaaatatcggatccggtttgattttaatagacgggagaggttttatcaatctcgtgaaccggtcatacacgaagcagtttcatacaaagcctgaacgtctgcttcggcgtctttaccatgatgcgtttgaacatgaggagatcattcggcttgtcgaagacatttttatgacggagacgaaaaaatgccagctgctcagacttcccatcaacattgagcggcgctactttgaagttgacggcgttccgatcatgggccctgacgatgaatggaagggcatcgtcctcgtctttcacgatatgacggaaattaaaaaattggagcagatgagaaaggacttcgtcgccaatgtctcccatgaactgaaaacaccgatcacctcgattaaaggctttacggaaacactgttagacggagcgatgaaagacgaaaaggcgctttcagactttctgtctatcattctgaaagaaagtgagcggctccaatctctcgtgcaggatttactggatttatccaagatggagcagcaaaactttacgatgcgcgtagagtcctttgacgccgcaaaaatcctccatgaaatcgaagcccttttacagcataaggctgaggaaaaaggcatcagttttcagctcgatcttccggaggagccgatttttgtgatgggtgatgtgcacaggctgaagcaggtattcctgaatctggcgaacaacgctttaacctacacgcctgaaaaagggacggtggcgatttcggtaaatgtgaaagaaaccgctgtcgatatcaaagtgtccgatacgggaatcggcattcagaaggaagagattccgcggatatttgagagattctaccgcgtggataaagacagaagccgcaactcgggaggaaccgggctcggtcttgccatcgtaaagcacttaatagaagcccatgaaggtaaaatcgaggtcacaagcgagccgggacaggggactgtatttaccgtgacgctgaagcggcagccggaagcgtgatcagctttacaaaggattaacaatttcttcatgacctgttaaacctatcttgttaggatgtaacagaaccccttcatccaaggagccaattttgacggcgggaacgtgttttcttgttcccgtccttttttgcgttttcacggggttcgctcattttcctttcaaattgaactttgttaaaataagagaagctgtgagattaaaaaatagaggaatgacgagcttttgctcttaggaggatattgaatgacggaacgaaaaaaattagtgcttgtcgacggaaacagtctggcgtaccgagcgttttttgcattgccgcttttaagcaatgaaaaaggcatccatacaaatgccgtatacgggtttgcgatgattttaatgaaaatgctggaagatgaaaagccgacccacatgctggtggcttttgatgcggggaaaaccactttccgccacagcacgtttaaagaatataaaggcggaagacaaaaaacgccgccggagctttcagaacagatgccgttcatccgcgagctccttgatgcctataacatcagccgctacgagcttcctgaatatgaagcggacgatattatcggcacccttgctgtatctgctgaaaaagaaggcttcgaagtaaaggtagtttcgggggacaaggacttaacccagcttgcaaccgggaaaacgaccgttgccattacgagaaaaggcattactgacgtggaagattacacgccggagcacgtgcaagaaaagtacggtctgacccctttgcaaatcattgatatgaagggattaatgggggattcatccgataacataccgggcgtccccggcgtcggagaaaaaaccgcgattaagctcttaaagcagttccattcggttgagaaactgcttgattccattgatgaagtcagcggaaaaaaattaaaagaaaagcttgaagaatacaaggaacaagccctgatgagcaaagagctggcgacgattatgacaaatgcgccgattgaagtcaagcccgaagatttaggttaccaagggtttgaccgtgaacaagttgttgccatttttaaagacctgggttttaatacgcttcttgagcggctcggtgaagaaagcggggaaacggcggaagaaaattttgaagacatcaatgtcgaaatggcagaagaaatcaccgaagatatgctcgtttcgccgtccgctttggtcgtcgaacaaatcggtgataactatcacgaagaaccgatcctcggcttttccatcgtgaatgaaacaggtctttattatattccgaaagaaatcgccattcagtctgaagcttttaaatcttgggctgaagatgaatcgatgaaaaagtgggtgttcgacagcaaacgttccgtcgtcgctttgcgctggcagggaattgagctgaagggaacggaatttgacgcgcttcttgctgcctacattataaacccgggcaattcgtacgacgatgtcgcgagcgtagcgaaagaatacgggctgaatatcgtttcaaaagatgaagcggtctacggaaaaggcgcaaagcgcgccgttccggctgaaaaagagcttgccgatcatctcgcgcggaaagcgtctgccgttaacagcctccgtgacaaactgctgcacgcgctggaagaaaataatcagcttgaattatatgaagatctcgaactcccgcttgcgctaattctcggagaaatggaatcaatgggcgtcaaagtggatgttgaaagactgaagcgaatgggcgaagagctcaaggcaaagctgaaagaatatgaagaaaaaatccatgacatcgccggtgagccgtttaacatcaattcaccaaaacagctcggcgtcattctgtttgaaaagctcggcctgccgccagtaaagaaaacaaaaacaggctattccacttcagccgatgtgcttgagaagctcgcagacaaacatgatatcgtcgcgcacattctgcaatacagacaaatcggcaaactccaatcgacttatattgaagggctgctgaaggtcacgcgcaaggattctcataaggtgcatacacgattcaatcaggcattgactcaaaccggacgcctcagctcaacggatccgaacctgcaaaatattccgatccggctggaggaagggcggaaaatccgtcaggctttcgtaccgtccgaaccggactggcttattttcgccgccgattattcacaaattgaattaagggtgcttgcgcatatttcaaaagatgaaaatctgatcgaagcgtttacgaatgacatggacattcacacaaaaaccgccatggacgtgtttcatgtcagtgaagatgaagtgacacaagcgatgcgccgccaggcaaaggccgtcaatttcggcattgtttacggcatcagtgattacgggctgtcacaaaacctcggcatcacccggaaagaagcgggcgcttttatagaccgctatttggagagcttcccgggcgttaaggcgtatatggaagaatcggtgcaggaagcgaagcaaaaaggatatgtcacgacccttatgcagcgccgccgctatattcctgagctgaccagccgcaacttcaacctgcggagctttgcggaacggacggccatgaatacgccgattcagggaagcgccgccgatattattaaaaaagccatgattgacatggcagctgagctgaaagaaaaaaacctgaaggcgcgactgctgcttcaggtgcacgatgaattgatttttgaagcgcctaaggaagaaattgaaatattagagaagctggttcctgaagtgatggagcatgctttggcattagacgtgccgctgaaggcggattatgcttcagggccgtcttggtacgatgcaaaataaacagagaaaaaggaagtgatgattgtgccggaattaccagaagttgaaacggtccggcgcactctgaccggtcttgtgaaggggaaaacgattgaatcggcggatatcagatggccgaatatcatcaaaaaacccgccgagccggaggaattcgcgcggcagattgcaggagaaacaatccgatccatcggaagaaggggaaagtttttgcttttccatctggatcattatgtcatggtgtcccacctgcggatggaggggaaatacggtcttcatcaggccgatgagcctgacgataaacatgtgcacgtcgtgtttcacatgacggacggaacacagctccgctaccgggatgtccggaaattcggcacgatgcatttgtttgcgccgggagaggaacagaatgcattaccgctttcacagctcgggcccgaacccgatgatgaagcatttaccgctgcttatttaaaagagcggcttgcaaaaacgaaccgcgcggtgaaaacagccctgctcgaccaaaaagcggtcgtcggcctcggcaatatttatgtcgatgaagctttattccgggcgcgtattcatccagagacaaaagcgaacagtctgtcagacgggcagataaaaacgcttcatacagaaattaaagacacccttcaggaagcgattgacgcgggcgggagcaccgtccggtcttatatcaattctcaaggggaaattggaatgtttcagctcaaacattacgtatacggcaaaaaggatgaaccgtgcaaatcgtgcggcacgatgatttctaaaatcgtggtcggcggaaggggtacgcatttttgcgcccgctgccaaaaaaaatcataaactgaagcggttcaagcaggcggcagcagaatgacttttttctaacacagttgatgacctttctccatatatatattgtgattcacccaataggcatatgtcacaattgccgatcaagagaaagggagaaacggatatggagattgtttctttgctgcttttggcttttgctgtcagcttggacagtttttcagtcgggtttacgtatggtttgagaaaaatgaaaatcccgttcaaagcgattgccgtgatcgcttgctgttcagcctctgtgatgtttatatccatgctgatcggccattttctgacaaagatttttcccgtatccgtcacggagaaactgggcggactgatcttaatcggaatcggggcatgggtcatctggcaatttttcaaaccggctaaagagccggattacttattgcatgaaaaaacgttacttaatcttgaagtgaaatcgctcggcatcgtcattcatattttgaaaaaaccgaccagcgccgatattgatcaatccggaaccattaatggagtcgaggcgtttctgctcggtatcgccttatccattgacgcgtttggcgccgggctgggagcggccattctcggcttttctccggttatgatgagcgtgactgtcgggctgatgagctcgctgtttgtttcactcggcataaatgcggggcatttgctttcaagatggaattggatagataaaatgacatttttgccgggagtcctgctgattatcatcgggatttggaaaatgtaagaaggagtgggctttttgagcttggtcatcggtttaacgggaggcatcgcaagcggcaaaagcacggtagcgcgtatgctgatcgacaaaaaaataacagtcattgatgcggatgccatcgcaaaacaggcggtggaaaaaggaatgccggcttacggacaaattgtggaagcattcggaaaagacatcctgctggaaaatggcgatattgacagaaaaaaactcggttctatcgttttcactgacgaacaaaaacgtctgaagctgaatcagatcgttcatccggcggtgcgtgcggaaatgctgaaacagcgggatgaagccgttgcgcgaaaagagcagttcgtcgttttggatataccgcttttgtatgaaagcgggcttgattatcttgtcggcaaggtgctcgtcgtcaccgtaccggcagacattcagcttaaacggctgatagagcggaattcccttacagaagaagaagcgatgagccggataacgtcgcaaatgcctttagcggataaaacaaaaaaagctgacgccgtcattgataacagcggcagtcttgaatatacaaagcaccagcttgaggaagtattgagcggctgggcataaacaaacaccgttcggaaagccgaacggtgtttgtctggttaaaaatcaaaattgtcagggtccggaccgacacggaggttttcgttcagatcatcaatccgcttcatatcgtcagctgacagttcgaaatcaaagacatttgcattttcttcaatacggtgttttttcgttgatttcggaatggtgatgacaccgttttgcaaatcccagcgcaaaatcacttgagcggctgatttgccgtacttctcagcgatttcctgtaagacggtgtgatcaagcagctgaccttgcatcaatggcgaccacgcttcaagctgaatgccttgttcagtgcagaaagcaagcagttctttctgtgtcagatgaggatggtactccacctggttgatcatcggcttgatttccgtctctttcatgagatgtttcagatggtgaatttggaaattgctgaccccgatcgccttaatgcgtccatcccggtagagggtttcgagcgcccgccacgcatcgatgtactttccttcgacaggccaatggatcaaatataaatccaaataatctaaaccgagtttttctaagcttgtgtcaaacgcttttaacgtttcttcatatcctaaatcggcattccatacttttgacgtgacaaaaatgtcttcacgttttaatcccgcttcttgcagcccttggcggatgccttcgccgacaccttcttcatttccgtaaatcgcggcggtatcaacgctgcgatagccgtgcaccaatgccgttttcaccgcgttgacgagttccgcgccttcctctactttgaaaactccgatgccgaaccaaggcatttctactccgttatgcaatgttgcttttgcttgtaaatgtgttgtcatgtatatattcctcctattagttgtctgttgaaacaatcaaaatgcgctgaagaaaaactcacctcctttcaagggcagtgcgatcccgcttttcaagcttcctgctccatccggttaatacgaccgcgctgagcaccatcagcgccccgatccaagcggtatgaatgattccgattgagtctgtaatgattccgccggcaaacgagccgatcgcgattccggcattaaatgccgcgatatttaaggctgatgctgtatcaacggcgcttggcgcaaaacgttcactcagcatcacaacatatacctgaagccccggcacattcataaacgccaacagccccatgaaaataatggtgatcagcccggctgttttaaacggcgcggtaaaagtcagaacaaacagcacagcagcctggacaatgaacatataaaacaaggctttcagcggatttcggtttgataaacggccgccaatcatgtttccgatggcaatcgcaattccgtaaacgagcaggatggccgcgacggtttctttctgaaaaccggttacctcctgaagaagcggagataaatacgtaaacacgacaaacgttccgccgtagcctaacgccgtaatcataaataaaagcaataaccggccgtttgtgacgagtttgacctgctcggaaaatgcggttttcgtccctttgcgcaaatgcgacggaacgaggagcgcgtttgtgaggaatgcgatgattcctactgccacaatgacggcaaatgcgattctccatccgaattgctggccgagataggtgccgaacggaacgccggtcaccgtagccaccgtcagtcccgtaaacatgatagaaatcgcgcttgctcttttatgctccggcacgatattggcggcgattgttgccccgattgacatgaaaatgccgtgggaaaaagccgaaataacccgtgccgccagtaagacgccgattgaggaagcgctcgctgcgagtgtatttccggcgataaaaattaacatcacccagagcagcagcgttttccgcgacatgccggatgtgagagacgttaaaaccggcgcgccgaatgtcacgcccagagcatacatggaaacggtaagtcccgccgttgtcacaggtatatgcagatcttgagatataagcggcagcagcccgacgctgataaattcggttgtgccgatcgcaaaagcgctgacggctaatgccagcagcgctggtaaatagctttggcgatgtgaagacatctgttttcctccttgaacgataatgtatggttgaaatgatgccgggtaaacgatataagtataagagtacattccttttcagccggcaaatgtcattatgatcgatagaagtgtcattgaaaagaacgtacttttaagtgccataggcactttttagttcctatagatgaggaggaattaccgttgctgaagaaaaaatacaatatatccgtagaggcggcgcttgaagtgatcggcggaaaatggaagtgtgtgatcctctgccacctcatgcgcgggaaaaaacggacaagcgaattgaagcggcttatgccggacatcacccagaagatgctgacacagcaattgcgggagctggaagctgacggcgtcatcaaccggatcgtgtacaatcaggtgccgccgaaagtggaatacgagctgagtgaatacgggcacagtctggaaagaattttaaacgcgctgtgcgactggggcgcgatgcatattgctaaacggtacggcgaggtgtcttccgttttagaggacagcattttaaatgacaaatttaaagaaccgggacaaatataagaaaaaagcaggcagcctgagacgctgatcctgctttttttatggaagaaagatcattttatatgcaaaaaaaccgattgaacaacatattgatcggtataagggtggatttttatcaagttgtactggcggatttcttttaatgtgttatactatatataaataaaggtaaattagagtggcatattaaaaaggggtgacctgagcatgaaggtaaaagtagcaatcaacgggtttggaagaatcggaagaatggtgttcagaaaagcaatggaagatgatcaaattcaaataacagccattaatgcaagctatcccccggaaacgcttgctcatttgataaagtatgacacaattcacggcaaatatgatcaagaagttgagacctccgacgacagcctgatcgtcaacggaaaacatattatgctgttcaaccgccgggacccgagagagcttccgtggaaagaatgcggaatagacatcgtcgtagaggcaacggggaaatttaattcaaaagaaaaagcgatgagccatattgaagcaggggcgaaaaaagtcattttaacggctccgggcaaaaatgaagacgttaccattgtcatgggagtaaatgaagagcagttcaatcccgatgaacatgtcattatttcaaatgcatcctgcacgacaaactgtcttgcgccagtcgtcaaagtgcttgatcaggaattcgggattgaaagcggcctgatgacgactgttcacgcttacacgaatgatcaaaaaaatatcgacaatccgcataaagatctgcggagggcgagagcgtgcggagaatccatcattccgacttctactggcgccgccaaagcgctgtcgctcgtgctgcctcatttgaaaggaaaacttcacggtctcgctttgcgtgttcccgttccgaatgtgtcattagtggaccttgtctgcgatctgaaaacagatgtgtcggccgagcaagtgaacgccgctttccaaagagccgcaaaaacgtcgatgtacggaattcttgattattcggatgagccgctcgtttcttcggattataatacgaattcacactctgcgatcatcgacggtctgacaacgatggtgatggaagaccgaaaagtaaaggtgctcgcctggtatgacaatgaatggggatattcctgccgggtcgttgatctaatccgtcacgtcgccgcgcgaatgaaacacccgtcagctgtgtagactaaagatcatggacatttgttagaaaaaaacccttaacggcatattcgcaaaaaacacaccttgcaaaataaacttaaacacagtatactatctttcgtgaacttcttgctcgtgactgcttcggaattacttaaagggttaggacctctccggactaactttcccccgtggtaaatggccgggtcagttctcggaaattcacttttttaattcttgttaaggggggtccatgattatggaaacaatggggcgtcacgtcatctccgagctgtggggatgcgattttgataagctcaatgacatggattttattgaaaaaacgtttgtaaatgctgctttgaaatcaggagctgaggtgcgcgaggtcgcatttcacaaatttgcaccgcaaggcgtaagcggagtcgttattatctctgagtcacatttaacgattcacagttttcctgaacacggatatgcaagcattgatgtttatacttgtggagacctggatcctaatgtggctgcggattacattgcggacgcattacatgcagatacaagagaaaacattgaaataccgagaggaatggggcctgtacagattaaacaggcacaagcgaaagtactgtaattttcaaaacgcaaacacaagggagctaagctgaaaaagccattacgcgctttgaagctgatgctccttttctaatgtaaaaaaacagcattgctttttctttaagcattttttttgtaaaatagaaaagataaggccggtctatcggctctcccaacaaataggctcatcctagaaacgttggcgggcatttaccggaagcttgcgaaccgcattacagcaacgaaacagatgggagctgatccaatttgaaatgtccttcatgccagcacaacggttcccgcgtacttgattcacggcctgcggacgaagggaaatcaatccgcagaaggcgggaatgcgaagcctgccattaccgcttcactacatttgagaagtttgaagagatgcctctgatcgtcgtgaaaaaagaaggcgtccgggaagaattcagccgtgaaaaaatgctgcgcgggttaattaaagcttgtgaaaaaaggcccgttcctttaaaaacattggaagacatgtgctttgacattgaaaaagagctgagaaaccaaggtgtatctgaagtcaaaagcgaacttgtcggagaaatggtaatggaccgtctggcgaaaatcgatgaggtgtcttatgtccgctttgcctccgtctaccggcagtttaaggatataaacgtgtttatcgatgaattgaaagatttaataaagaaagaacgctgagagagctaagagattgtgtctggctcttttctcatgagcaaaattggcatttgatagatcgcagaaacggtgtaaaatgagagtagaaacatatcggaaggtttgagaatcatggctgactattggaatgacgtattgcctgtagatccttatacggtcaaaagccgttcgcttcttcaggatgtcgacagacaggttttgacacatctgtaccagccgctgatcggttcttttgcattctccctttatatgaccttatggggggagcttgagcagaaccgcttgtggggagcggaatccacgcacaggcagctgatgggcatgatgcagtcaaatttaaaaaagattcatcatgaacagggaaagcttgaaggaatcgggctgctgaaagtgtatatccgggagtccgagcagaaagagcggatgtttatttatgagctgctgcccccgctcagaccgaatgatttttttgaagacggcatgctgaatgtctttctttataacagagtcggtaaaacgaaataccagcagctgagacaattttacacgcacccttccgtcggcgcgggcgcaagggaaattacccgtccgtttaatcacgcttttgcctcttttcagccgagtgaatggaaaatgacgcctgatatggaagaggcgatgaagctccccgaggactatgagacggcgtctgtcggacaagcgccttcctatacggtgacggaggaagtatttgattttgagcttttcatggcgggactgtcagaaacgatgataccgcgtaaatcaatcacgcaggacgtgcgggagagcattaaaaagctttcatatttatacggaatagatcctatctccatgcagcacgtcgtcatgaccgcaattaatgaacaggatacgataacggccgaagcgctgaggaaagcggccagcgactggtaccaaattgaaagaagcggtaagcttccggaactgattgataaaacacagcctgtcaccttgagagaaaaccggacggaaaaggacgattcattgaacggcgaactcatcgcacagcttgagaccatatcaccgagaaagcttcttcaggacattgcggacgggaccgagccgtcaaaagccgacttgcagattatcgccgatattatgttcgaacaaaagcttgagcccggcgtcaccaatgtgctgatttattatgtcatgctgaaaacggatatgaagctgtctaaaaactatatccaaaaaatcgccgcccactgggccagaaaaaaagtcaaaacggtacgggaagcaatgaaactcgcaatagaagagcacaggcaatatcttgattgggcggacggcaaaacaaacggcgcggcgcgcggcaaaaaaaccgtccgggaagaaaagcgccctgattggatgaaagaagaagaaaccgggaagaaacaagaacagccggctctttccgcgcaggatcttgaagaacagaagaaaaaaatgatggaagaaatgaaaaaactgaaaaaatactctgcctattgagacagagaagcggggtgatattgaatggaaccgatcagccgatccttagaaggcgtgacgaaaagacctgactttcaaaaacgcctggaacgaatgcagcagcaagtcatggccgacgaagacgtccaggcttttttgaaggaacagaaagatgtaatcaatcaaagcatgattgacagagggttaaataaactgtacgaattcgttcagcaaagcaaacagtgcgccttctgctcgaaagacagccggacgaacagcctgcttgaaggctatcatccgaagcttgtgatcaacgggcgttccatcgatattgaatattacgaatgtccggaaaagagaaagctcgaccgtcagaaaaggcaaaagtccctgatgaagagcatgtatatccagcaggatcttctcggcgcgacgtttcagcagatcgacattaccgatccgagcagagtcggcattttccagcatgtgacggattttctgaagagctataatgaaacgggaaaaggcaaagggctgtatctgtacggaaaattcggaatcggaaagacatttattttagccgccattgctaacgaactggcggaaaaagagtattcatcaatgattgtatatgttcccgaatttgtcagagagctgaaaaactcgctccaggatcagtcgttggaggcgaaactgaatatggtgaaaacgacgcccgtactgatgcttgatgacatcggagcggaatcaatgacaagctgggtcagagatgaagtcatcggcaccgtgcttcagcacagaatgagccagcagcttcccactttcttctcgtctaatttttcaccagacgagctgaagcatcattttacgtattcacagcggggagaaaaggaagaagtaaaagcggcaagactgatggagcggattttatatttggcttcgcccgtccgtcttgacggggaaaaccgccgccgttcatgatgccggcgtccaatgggaaggatttgagggaatgaggaataagaaggctgtcacttgggctgcggctgcggcgggagcgggccttttgctgtgggcaaaccgcaaatatctgaatctgtcgcctaaggagatccggctgtgggtgttatcgttcggtgtttttgcgccgcttgtgtttatcggaatttccatcgtcaggccttttgtgctgtttcccgtatcaatcgtttccgtcgccggaggattggcgttcggcccgcttttcggcaccgtgtatacgctggcgggctcaatgggcgccgccgccgcgtctttttttgcggcggggctgtttgcctttaatgagaaaagccgtcatggaaaaatggaagccattcaaaagcagatgaaaaccaatggcttcttttatatttttatcctgcgtattctgcctgttaactttgatgtgatcagctatgccgcgggcctatcgaaagtcaggccgatgacgtattttttggcgaccgcagcgggcatcattccggggacgatcgtcctgaatgtgctcggcgcgagctttatgtccggcaatgtgctgaccgtactcggcgtgatctgtctttacatcgtatttttatcgcttcccgttatatttaaaaagaaggtgcgccatttgttcggcggtgaaagctaacctttacgtctattttaaaaacatcccccatatacttgtaacagatgccgtaaggggggacaaatatgcttgaagtgatctttgaagatgaccacgataccgccgcttttttacatctcattcagcaatcggacgaccggagacattttattgtccgtgaaggcataaaaaaagtcggaatcgcaaggtctgaaacggctttttgcgttcagcgctttattgagccgatacttgtcaggttttttttggaatgcaaagaagacgagcatatgctttcgcttattgaggacgcatactgcttcaccgatcaggatgaacagcagcaaatccttcagcttgcacacagcattatggaaggagagcttgatgatcatccgttcgagccgaagaaagagccgcgcacacagtttatttcagatgcgctccggacgatttcacttgatgcgggtgttttttccgtgcgttcgtttcagacgttccggctcggcaggtattatgagcggctcagagaatacgcggaggctgcgatagatgaataccggatggaacaggaatatcaaaactttatccagtctctgagagattatgtgacatccaatccgccgcggatgaagaaagtccgcatcgtacatgaccgggcttttacgctgtgggagctgcgctatttgtcagaacgggaacagaaaaaatacatagacagacggtttgtgcgggagcacccgatgtatatagattcccatctccttgcgccgctgatctccattgcgcctgagacggtagaactgtatacggacaaaccggagcatatgatgtccagaacgattcaaaacgtgtttcaggagagggtgcgcctttttccgctgggcgcatttgcagccgagaagacggaaggatagccgcacggacggccttgtgtaagcggcaaggctgtctttgcgaaatcagacggaaaaccgagttgcatttttctcacagacattttataatacataaaagattaatgattgctacacgtattgataaggacatgaagcattgataccggctttataagagaggagagcccaggctgaaagctttccagctatggatcattgtctttaccgcctttgaacttcagctgtgaacgccggaagaagcgccagtaatagctgacgggaactcccgttacagagtttagagccgcaggtgccgaaacaatcggccgcgcggaaaaaagggtggaaccacgattccgtttatttaacctcgtccctttcatagggggcggggtttttgatttgcataaaaaaaggagtgacgaagatgtcagatatgatcaacatcacatttccggacggagcggtaaaggaatttccgaaaggaacaacaacagaagatatcgcggcatccatcagtccgggattaaagaaaaagtctttagccggaaaactgaacggacaggaaattgatttaagaacgccgattcaagaggatggtgccgtagaaatcattacagaaggcacagaagaaggcttgaacatcatgcggcacagcacggcgcatttattggcccaggcgattaaacgcatttataaagatgtgaaattcggagtcggccccgtcattgaaaacgggttctattatgacgttgaaatggagcaggcgctgacgccggatgaccttccgaagattgaaaaagaaatgaaacgcatcgtcggtgaaaatctgccgattatccgaaaagaagtgagccgtgatgaagcaaaagccatgtttgcggaaatcggcgataatctgaagcttgaactgctggatgccatccctgaagacgaaacggtctccatttatgagcagggcgaattttttgacctgtgccgcggcgtgcacgtgccgtctacaggcaaaattaaagaatttaagctactgagccttgcgggcgcatactggcgcggcgacagcaaaaaccaaatgcttcagcgcatttacggcacggccttctttaaaaaggatgacctgaaagagcatttgcggatgcttgaagaagcgaaagaacgtgaccaccgaaaactgggcaaagaattaaaattgttcgccaactctcaaaaagtcggacaaggcctgccgctctggctgccgaaaggcgcaaccatccgccgcgtgatcgagcgctacattgtggataaagagctgagcctcggttatgagcacgtctatacgcctgttctcggaagcaaagacctgtacgaaacatcgggccactgggaacattatcaggaaggcatgttcccgccgatggaaatggacaatgaaacactcgtgctccgtccgatgaactgtcctcaccatatgatgatttacaaacaggacattcacagctaccgcgagcttccgatccgcatcgcagagctgggaacgatgcatcgttatgaaatgtccggggcgctttcaggtcttcagcgcgtacgcggcatgacgttaaatgacgcgcacattttcgtccgccctgaccagattaaagaagaattcatccgcacggtccgtttgattcaagacgtatacgaagacttcggcctgagtgattacacattccgcctgtcttaccgcgatcctgaagatacggaaaaatattttgatgatgatgagatgtggaacaaagcgcaatccatgctgaaggcggcaatggacgaaatcggccatgactactatgaagcggaaggcgaagcggcgttttacggccctaagcttgacgtacaggtgaaaacagcgatcggcaaagaagagacattgtcaactgtacagcttgacttccttcttccggaacgctttgatctcacttacgtcggagaagacggcaaacagcaccgccctgtcgttattcaccgcggtgtcgtgtcaacgatggagcgtttcgttgctttcttaatcgaagagcacaaaggcgcccttccgacatggcttgcgccggtgcagttccaagtcattcctgtatcaccgtccgtgcatcttgactatgcgaaaaaagtgcaggagcgcctgcagcgtgaaggcctgcgtgtcgagcttgacagccgggacgagaaaatcggctataaaatccgtgaagcgcaaatgcaaaaaatcccgtacatgcttgtggtcggtgaccaagaagcggaaaacggcgcggtaaacgtccggaaatacggcgagcagaaatcagaaaccgtctcattggacgattttgtgaaaaaggctgtagccgaagcgaaaaaataaccggaaatacaaaaaccccgttcattcagaatggggtttttttgcgtataaaattatctttctttttgtttctctataatcgcaaacagctcgtgaagatcgctgatcacgtaatcaggcgcaatgtccgtatcatttttcttttgcgtccggtttacccagactgtcgtaatgcctgcccgtttcgctcccaatatatcagtattgaggttatctccgaccataatggcgtcttcttttttcaggttcaggaggccgaggcaatgttcgaatatggaggcgtcgggtttcccttttccgaaagcgcctgagatgacgatttcattaaaataaggcgcaagctcaggaacgccggcgagtttttctttctgcaggctgggatcgccgtttgtcagcagaagcaattcataaacacctttcagcttatcaagcaccgcaaacgtttcatcatacacgtacggacgctgtctgcgttccgccgcgaaaaactccgccaaatattcgccgtaagccgcatcgtctataccgacgctttttaagccgttcgtccaggcgtttcgtctgtattccggcgcaatccgattcagctgtttaaatccttcgctgaccggctcggaaaaattcgcccacaatccttcaaacggattaatgccgatcatgaccgtataaggataggtttcgtatgacatatacaattcccgtgccgctttccgaaccgcatcttcaaatgtatgcgggtcaaggccatattttttttccgcttgtaaacatgtttccctgaatgttgttctgacgcttttttcatcccataacagtgtatcgtccaaatcaaaaaatacggctttcatgatcttctcctctttgttatattctgaaactctctgccgcaaggctcccgtttattctacaatagatatatagactgtgaaagatttgttttcagatgatttgaaaaaaacaggcaggtttgtgtcagattctgtctcaggctctaaaacgtgataaaattaaatttgaaagaacaggtgaaaagtatgctgcatttgatcatcatgatgctggaaagagtcggaattatcgtcatattgggatttgttctggctcataccagattgttcagacaggcgctccagcagcctgagagctataaaggcaaagcggtgctgatttcaattttctcgctgttcagtatcatcagcaactatacgggaatagaaattcagcggaatacaatcatgaataatgactgggtgtttcaaattaatccgtccggttcaattgccaatacaagaattatgggcgttgaaatcggcggactcttaggcggcccgtatgtggggatcggcgtcggcatactggccggcctgcatcgtttatcactcggcggcgcgaccgcagtcagctgtgccgtctcatccgttttagcgggcattttgtccggctggatcggacggtatttcagaaaacgctatgcgatgccgacaccgcgggtggccgcgcttgtcggactcgggatggaatcgctgcaaatgctgctcatcctcttgatggccaagccgttttctgatgcttggacgcttgtgagcatcatcggcatcccgatgatattggtaaacgggtcagggacttttatttttctttcgatcattcagtcgattatccggaaggaagaacgggcgagagcccttgaaacccacagggtgctgatgattgcagaccagacgcttccgtttttccgccaggggctgaatgaaagctcatgcaaaagcgtcgccgccatcattcacaggcaaacaggaacggacgcggtatcgcttacggataacgaaaagattttggcgcacgtcggcgcgggtgccgaccatcatattccgtctgaaagcctgatcaccggattgtcaaaacgtgtcattaaaacgggtcatattatgaaagcgacatcgaaggaagaaattgaatgcacgcacgatccctgtccgctgcatgcggcgatcgtattgccgctgacgtcaaacggcaaaacgatcgggacgttgaaaatgtactttaaaagcccgtcaggtttaagccgggttgaagaagagcttgcagaaggactcgccatgctgttttccacccagcttgaactcggcgaggcggaactgcagagcaaattgctgaaagacgcagaaataaaggcgcttcaggcacaggtcaatccgcattttctgtttaatgcgatcaatacgatttctgctctttgccgtacggatgtggaaaaaacccgaaagcttctgctgcagctgagcgtctatttccgttccaatctgcagggggcaaggcagctgctcatcccgctttctaaagaactgaaccatctgcaggcgtatttatcattggagcaggcccgttttcccgggaaatataaaatcagtcttgaaatcgaacgcggtttggaggacatcgaaattcctccttttgtgctgcagattctcgtcgaaaatgcgctccgccatgcattttcaagaaagcaggacagctgtgccgtcaatgtcagcgtggtatccgccggtcagtcggttttaatgcgggttggagataacgggcggggaattgatccggaattgctgtccgtgctcggaaaccgtccgctgccgtctaaagaagggacgggaaccgcgctttacaatttaaatcaacggctgatcgggctgttcggccccaaagcagccctgcgattggaaagtgaggccggcaaaggtacggacgtatcatttgagctgcctttgaaactgatgactaaaggagaagaacatgctgaaggtgttaatcgttgatgatgaaatgctggcaagagatgaattagcttatttgctgaaacggacgaatgaagtaagtgacataaacgaagctgaaaatattgaatccgcttttgacagtatgatggatcaaaaaccggatctgctgtttttggacgttgatttgtcaggagaaaacggatttgacattgccaaacggctgaaaaacatgaaaaatccgccggccgtcgtttttgcgacggcgtatgaccaatttgctttaaaagcctttgaagtcgacgcgctcgattatttaacgaagccttttgatgaagaaagagtgcgccagacgatcagaaagtttaaaagagtgaagcgggacagggcaggagccgtctcagagcagccgtccgcagccggagcgcataaactggctgtatcagccggtgaatctattgtcattttagatacgaaggacattattttcgccggcatggaggacggacacgtttccgttaaaacgtttgccgcgtcttattccgttcatgaaactttggcggtcattgagaaaaaactgcctgatacgggtttcttgagagtgcaccgcgcgttcatcgtgaatacggagcatattacggaaattcatccgtggtttaattcgacgtacaatcttatcttaaaagacggctctaaaattcccgtcagccgtacatacgccaaggacttaaaaaagctgcttcatattatatgaggcggcttttgcatttcagcagccgtttcttgcatttcagaatgaatattcagccgtttgttatgaaagcgctttaaaaggcgatttctcttttataatgaacctaacaaagagaaagaggtgaagaaaatgagtgcgaaaaaagtgtacggatttctgacacaagcatttatttttgccgtaattatgctcatatctaatgggattgcagcgattgtccccattcctatacccgcttccgtagtaggtttggtgttattatttgtcctcttatgcctgaaagtgattaagcttgaacaagtagaaacgctgggaacatcattaacgtcactcatcggatttttatttgtcccgtcgggcatctccgtgatgaattcacttggcgtcatgcagcagtacggcgtgcagatcgcactcgtcatcttactcgctaccatcattctgttaggggcgacgggccttttttctcagctgatcttgtctgtcagccaaaaacgtcagaaggcagctcctgaaaaacaaacggtgcgccgttccaatcaggaaaaagaacttgtgcagcattaggagggaaatcggatgagtccatatttcggtattgtcgtttcacttgcggcctttggcatcggcacgtatttatttaaaaaaacgagaggctttttcctcttcaccccgctgtttgtcgcgatggtgcttggaatcctttttctgaagctcggcggtttttcatatgaagattataaaagcgggggagacattattaaattcttcctggagcccgcgacgatcgcttttgcgatccctttatacaaacagcgtgacaaactgaaaaaatactggtggcagatcatgtcttctatcattgtcggctctatctgctcagtcacgattgtctatttgatcgcaaaaggcattcatcttgacgcggccgttatgaaaagcatgcttccgcaggcggcgacaacggcaattgcccttccgctgtcaaaaggaatcggcggcatcaccgacatcaccgctttcgccgttattttcaacgccgttatcgtctatgctctgggcgctctattcttaaaattgtttaaagtgaaacacccgatctctaaaggactggctctcggcacatccggacacgcactcggtgttgcggtcggtattgagatgggagaagtagaagcggcaatggcaagtatcgcggttgtcgtcgtaggagtggtgacggtgctggtcattccggtattcgttcagctcatcggaggataaacccgggtcatagacccgggtttttttattgtgttggcacgtccgcgtgcggcaaagaacgaaatttcacatttttccttgcgctcgccccggcatcgtgttaaaatgaaaaagttgatccggagaagtcattcttgactaatgatccggtattgtgtagaatagttattgaattgaatataaatcacaagcagaggcacccgcttctcacctgattgacacattcatgtagttggcaggttgaccgtacatttttatttatgcagatgttcgtagtgtgggtgtgttgtcatgcccgcactttttgtttgcctgcagaatgcagtcaacaagcgttgtgaatcaattcgaagaaactatggaggtggctcattattagcaaagatcaattggttaatgagggtatccgtgcacgtgaagttcgtctgatcggacaaaatggcgatcagctcggcatcaagtcccgtcaggaagcacttgaaatcgccggccgcgcaaatcttgaccttgtgttagttgcagcaaatgcaaaaccgcctgtctgccgcatcatggactacggtaagttcagattcgagcagcagaaaaaggacaaagaagcacgcaaaaatcaaaaaatcattaacttaaaagaagttagattaagtccgacgatcgatgagcatgactttaacacgaaattgcgcaatgcgattaaattccttgaaaaaggcgataaagtgaaagcttctatccgctttaaagggcgcgcaatcactcataaagaaatcggccagcgcgtattggaccgtttctctgaagcatgtgcggaagttgcgacagtcgaaacaaaaccaaaaatggatggccgcagcatgttcttaatgctcgcgccgaaaaacgaaaagcaataaggaggaaatcccatgccaaaaatgaaaactcaccgcggatctgctaaacgttttaaaaagacaggttctgggaagttaaaacgttctcatgcatacacaagtcacttattcgccaacaaatcccaaaagcaaaagcgtaagcttcgcaagggtgctattgtgagcgcaggagacttcaaacgcatcaaacaacagcttgccaacatcaagtaatcggacaaggaacaattaggagggaaatataatgccaagagtaaaaggcggaactgtgtcgcgtcagcgtcgtaaaaaggttcttaaattagcaaaaggttatttcggttcaaaacatagattatacaaagtagcaaaccagcaggtcatgaaatcaggaaactatgcattccgtgaccgccgtcagaaaaaacgtgatttccgtaagctttggatcactcgtatcaacgctgctgcacgtatgaacggtctttcttacagccgtttaatgcacggtcttaagctttcaggcatcgaagtaaaccgcaaaatgcttgctgatcttgctgtaaacgaccttactgctttcaatcagcttgctgatgctgctaaagctcagttagacaagtaagttgaaaaagccgctctctttccgggagcggtttttttacgtaaagggtgacaatcaatggctctcttcatttacgccgtattgataaacggatacggcttttggatcatgggcgctgataaaagaagagcaaaggcgcacaggtggagaatatcagagaaacgaatatggctcacagccgccatgttcggctcactcggcgtatggatcggcatgcgcaccttcaggcataagacgaaacacaaatcctttttatacggggtgccgctgctttttctcactgaagccgcccttgtgctgatgtatttggtgtataaagaataaaaagcaggagagcttatcgctcgcctgcttttttcgcttttttgatgggctggtcccaatcaatcttgcaattcggataccgctccaatacctttttttcgacttcttcaaaatcacctgcagaaaagcggttcagcttttccggattttcggtccatacaaatatcgtatgaataaacagcggatgatctttggaagggatatgcttttctccttcaaagagcactcctttataagtaagctggagattttttcgcgtgtttttctgttcgtcaataaaataaaaattctcttttgattgcgccagtctgagccttcttttcgggtttgcgtagaatttgacgcccatgtaaataaaataaataagaagtgcaagcaagacaatcctcaatactgtaatggccatatgtgtgaaggcacctcctcacctttgtcatgatctgatgtaatacgaaaaacaaaacaaaaggtttcattttttaagaagaaatagataaaaacatttacccgtttttcaggcgaattaatcgtatgcttcagcattggttttgtataataagaagggtagtgaaaaaaaggaggtttattgatgacaaaattagatgaaaagctcaccatgctgaaagcgttaacggatgcaaaagggataccgggaaatgagagagaagtaagacaagtgatgaaatcatacatagaaccatttgctgatgatgtcacaacagaccggctgggaagcttaatcgccaaaaaaacgggcaaagaaaacggtccgaaaatcatgatctcagggcatttagatgaagtcggttttatggtgacgcaaatcactgataaaggctttctccgctttcaaaccgtcggcggctggtggtctcaggtcatgctggcccagcgcgtcaccgtcgtgacaaaaaaaggggacatcacggggatcatcggttcgaaaccgcctcacattctgcctcctgacgccagaaaaaaagccgccgatattaaagagatgttcatcgatatcggggcgtccagccgtgaagaagcaatggaatggggcgttcttccgggtgaccagattgtgccgtattttgaatttacagtgatgaacaatgaaaaacatttattggcgaaagcatgggacaaccgtatcggctgtgcgattgccatcgatgtattaaaaaaactgaaaaacagcgatcatccgaatgaagtatacggggtcggaacggttcaggaagaagtcgggctgcgcggggcgaaaacagcggcacatacgatccagcctgatatcgcgttcggtgtggatgtcggaattgccggagatacaccgggaatttccgaaaaagaggcgcaaagcaaaatcggcgaagggccgcaaattattctgtatgacgcgtcaatggtatctcacaaagggctgcgcgaccttgtcgtgaacacggcggaagaagcgggaattccgtatcaattcgattccattgccggagggggcacggattcaggttccattcatttaaccgcaaacggagtgccggcgctgtccattacgatcgcgacgcgctacattcacactcatgccgctattttgcatcgggatgattatgagaatacggtaaaattgatcacagaagtgattaaaaaattagaccgggaaacagttgaccgtattacttatcaataaagatacggaagaatctgcttttttaagcagattcttttttttgtctgtacaaatatgaaccctgcgtctacaataagagaagacatagcaaaaatctgacaacatgtttttgaaagcgctttaaaaaagggagggtttacaaatgaaaaacagattcagacgcatgatccgcttttcatgcgcagccgttacagccggtctgctgctgatgtcttcatctccggcatctgccgcgttttggggggcatcaaatgaattgctacacgatccgacaatggcgaaggaaggaaacacgtggtacgctttcggaaccggtttggaaggggagagggggcttcgcgtcttaaaggcgggcagcggcggcgtatggaccgttcagaaatcaatctttacttccccgctgtcatggtggggcaattatgtgccgaattacgggctgaatcaatgggcccccgatgttcaatattttaacggaaagtattggctgtattatgccgtttcttcattcggcaaaaatacctccgcgatcggtcttgcatcatctacaagcctcagttcgggaaactggaaggacgaagggctcgtcatccgttcaacaagcgccaataactacaatgcaattgatccggagctgacaattgataaagacggaaacccttggcttgccttcggttctttttggagcggcattaagctgacaaagcttgataaaaatacaatgaaaccgacgggatcactttattccatcgctgccagaccgaataacggcggagctttggaagcgccggccatcacctaccagaacggctactattacttaatggtgtcgtttgataaatgctgttcaggcgtgaatagtacgtacaaaatcgcttatggaagatccaaaagcatcaccggcccatatctcgataaaagcgggaaaagcatgtcagaaggcggagggacgattcttgactccggcaatgaccgctggaaaggcccgggcggtcaagacattgtgaacgggaatattttagtgcgtcatgcgtatgatgccgaaaacagcggaattccgaagatgctcatcaatgatatcgattggagttcaggctggccttcctattaattgatcagccgggcatgtgtgtccggcttttttacttgcaataaaagattgacagtttgattcctccttaactataataaaattgttcgtacaaataaaaggatagaagttttgttatttatattcgtacgtatatttttaagaatgcaagcgctttattttgataggaaggggaaatgaatgtgcttcagaacaaagaatatgaattttggtttgtaacgggaagccagcacttatacggagaggaaacgctgcagcttgtcgataaacacgcaaagggaatatgtgacggcctcagcggggtgtcatcaagatacaagatcaggcataaaccggttgtcacgtcatctgaaacgatcagagaggttttgcgggaagcgcagtatcaagaaaactgtgccggggtcgtgacgtggatgcatacattttcccctgcgaaaatgtggattgaaggtctttccgcttttcaaaagccgatgcttcatctgcatacccaatatcaccgagacatcccgtgggaaacgattgatatggactttatgaacagcaaccaatccgctcacggagaccgggaatacgggtatatccagtcaagaatggggcagacgagaaaagtcatcgcaggctattgggatgatgaggaagtcaaacatgacatttcgcaatggatgaacactgctgccgcttggaatgaaagcaggaatattaaagtagcccggttcggcgacaatatgcggaatgtggcggttactgacggagacaaagtcggcgcccacatccaattcggttggcaggttgacgggtacggaatcggcgatcttaccgaggtgatgaacaacgtcaccggcgcagaaattgaggcgctttatgaggaatacgacaaattgtatgtcatcagcggcgaaacaaaacgggatgaagcaaaagttgcttccattaaagaacaggcgaaaattgaactcggattaacggcctttctcgaacggggcggatatacagcgttttcgacctcctttgaagttttgcacggaatgaagcagcttccgggtcttgccgttcagcgtctcatggagaaaggttacggatttgccggcgaaggcgattggaaaacggctgcccttgtgcgaatgatgaaaataatggcggacggagaacaaacctccttcatggaagattatacgtaccattttgaaccggggcgtgcgatgattctcggatcacatatgcttgaagtatgtccgacgatcgcccttgatcagccgaaaatcgaagtccatcctctctcaatcggagggaaggaagatccggcccggttggtctttaacggaatcggcggttcagccatcatcgccagcatcattgatatcggcgggcgattccgtctcattctgaatgaagcggaaggcagggaaattgatcatgatatgccgaatctccctgtggcgcgggtgctgtggaagccggagccatcgctgaaaacagctgcagaagcatggattttggcgggaggcgcccaccatacttgtatgtccttccggcttacggctgaacagatgcttgactgggctgagatggcaggcattgaaagcatctttatttcccgcaataccgaaatacatgagctgaaaaaagagctgaaatggaatgacgtattataccggctgggagggaattgatatggcgtatacgattggtgttgatttcggcacattgtccggccgggcggtgcttgtcaatgtccgcacgggcgaagaaatcgcgtctgcggtaaaagaatatactcatgccgtcatcgaccgcacgctgccgaagacgggtgaaaaactccctcgggactgggcgcttcagcatcctgccgattatatcgaagttctggaaacggcgattccgaacctgcttcaagaggcgggcgctgatccaaaagacgtgatcggcataggaattgattttaccgcctgcacgattttgccgatagacggcgcggggcagccgctttgtatgctgccggaatttgaacgggagcctcatagttatgtgaagctgtggaagcatcatgcggctcaaaaacatgcagaccgtttgaacacgattgccgaagacacaaaagaaacattccttaaaagatacggcggtaaaatttcttctgaatggatgatcccgaaaatcatgcaaatcgcggaagaagcgccgcatatatacaaggcggcagatcggattgtggaagcggcagactggatcgtctatcaattgtgcggttcattgaagcgaagcaactgcacggccggctacaaagcaatctggaatgaggagacggggtatccgccggatcatttttttgaaaagctcaacccgttaatgaaaacgattacaaaagataaattaagcggcaccatttattcagtcggggaaaaggcaggaggtttgaccgaaaaaatggcggagctgaccgggcttctgccggggacggccgttgccgtcgccaatgtcgacgcccacgtgtcagtgcccgcggtcggtattacagagccggggaaaatgctgatgattatgggaacgtctacctgccatgtgctgctcggcgaggaagaacatatcgtccccggtatgtgcggggtcgtcaataacggcatcttgcccggatatgcgggatatgaagcgggacagtcctgtgtcggcgaccactttgaatggttcgtcaaaacgtgcgttccgagagactatgagaaggaagctgaggataaacacatagacattcacgagctgctcagcaaaaaagcagctgaacttgttccgggggaaagcggccttctcgcgcttgactggtggaacggaaaccggtcaaccttggtggacgccgatttgacgggcatgatgctcggcatgacgctgcacacgaagccggaagaaatctacagggcattgattgaagcgacggcgttcggaacgaggatgattatcgaaacgtttcgggaaaacggcgttccggtcgaggagctttacgcagccggaggaatcgccgaaaaaaatccgtttgtcatgcagatttatgcagacgtcacaaatatggacattcaattatccgggtctccgcaggcgccggcactgggctccgcgattttcggagcgctcgccgcgggacgggaaaacgggggatactccaatattgctgaagcatgtgcgcatatggggaaattaaaagacggctcttatgtcccggatcgaaaaagagctgagatttatgacagcttatatgcggaatataaagagctcgttcactacttcggcaaagaaaacaatgtcatgaaacgcctgaaagccattaaaaaccgtgattttgcgaaagggggaagccgccatgcttgaagcgttaaaagaagaagtgctcgctgccaatctgaagcttgaggaacataaccttgtcacgtttacatgggggaatgtcagcggcattgacagagagagcgggagaatcgtcattaaaccgagcggtgtcgattacagtgagctgaccgctgacaaactggtcgtcctgaatgaggacggagacattctcgaaggctcgctgaaaccgtcttctgacacgccgacccatctttatctgtataaagcgtttccgtctatcggtggaatcgttcatacgcactcccgctgggcgacgagctgggcacagtccggaagagacatacccgctctcggaacgactcacgcggattactttgaaagcgctataccctgcacgagggaaatgtatgaagaagaaattgtgaaagattacgaatatcatacaggcaaagtcatagccgaaacttttcaaaacgaaccgtatgaacaaaacccgggtgtcctcgtccacagccacggcccgttctgctggggaacggacgcgctgaatgccctgcataacgccgttgtgctcgaaacggtagcggaaatggcctaccattctcttatgctgaacaaacagctcagtccgatcgacagagtgctgcatgataagcatttttacagaaaacacggggcgaatgcttattatggccaaacttgacgcagccgggtttctgattgatttagacggaaccgtattcagggggcgggagctgattgacggcgcaaaagaagccgttcatacccttcagtcactgggcaaagccgttgtctttttaagcaaccgcggcaatctatcaagagcaatgtgccgaaagaaactgctgggtgccggtatccgcacggatgaacggagcatcgtgctgtcctccagtgtgacggcatcatttttaaagaagcattatcctttgtcaaaggcgtgggtgttaggagaaaaagggctgactgatgaactcgctttagcgggtgtcgccctggcgcaaaacccgcaggcggcagactggcttgtcatctccctgcatgaaaccgtcacctatgaggatctgaatctcgcttttaaggcggcttcctccggcgcgcgcatcatcgccacgaaccgggaccgctcctttccgaatgaaggcggccatgccatggatgtcgcgggaatgatcggggccattgaagcatccgccggagcaaaaacggagcttgtcatcggcaaaccgtcttggctgatggctgaggcggcatgtgaagcgctcggacttccctctgaggaatgcgccattatcggagacagcctcgaatcagatatcgcaatgggcagcctgtacgggatgaaaagcgtattggttctgacggggtcggccaaacttggggagccccgtctatatgaacctgacatcgtccttgattctattaaagacctgacagaattagcgaaggagggaacccttttatgaaacgttctcctgaggacattcaatccgagtttgacaaggaaggggccagccgctcaccgattcaaatagaagatatcgtgatcggggcgaatgcaaaagaagagcttctcagatttctgcaaaaaaaatgctggaatcatccggtcatcgtctgtgaccggaacacgtacgaggcggcggggcgtctgcttgcggacgaattgagggcaggcgggatcaaagcgtcaaaagtcattattccggagcatgaagccggggccgccgcggctgatgagaggacattggtctatacgctgatcaatctcgcggaagagacggatgtcatcattgcggccggtgcaggaacgattcacgacattacgcggtttgccgcctgccagcgcggattgccgtttatctcattccccaccgctccgtcagtcgacggttttacgtcggcgggagcgccgctcatattaaacggaatcaaaacgacgattcaaacgaaagcgccgatcgccttatttgcggatacgaatgtattaaaagaagcgccccgttcaatgacagccgcgggcttcggagacatgctcggaaaaataacatcgctggcagattgggagatttcccgcaggcttgcgggtgagccgtactcagaagccggggcgaagcttgtgaaagacgcgctttggcagtgcattgatcaccgcgctgacattgccatgggaacggaggccggcattcagatgctgatggaagcgctgatcgtttcgggtcttgtcatgcttgcgcttgaccactcccgccccgcctcaggaggagaacatcacatctcgcattggattgagatggaaatgctgaaggcaaaacagcctccgattctccacggtgcgaaggttggctgtgcgtgcgcggtgctgagtgatatttacaaagaactggcttgtcacgaaaagcttgctgaactgccgccgcactttcgcgaggcgattcaatctgcatatgaagggcttcccgacggcaagacaattgccgggtggctcgcatctgcgggaggtcccgcctgtttcgatgagatcggtgtaaaacaggaccttgtcagcgatgcgcttaagcatgcgcacacactgcgagaccgttataccggtttaaccatcataaatgaaaatgcagcgctctttgcacatcatttgcatcaatagccgcacggcctaaagtggaaggggtaatgacatgaaaaaaacgaccgctgtatgtttggtgctgatgatgctcttcttgtttaccgccggctgttcacaagaacggactgccggccggccgggagaaacagagctgacgttttggacatttaacggtctgcacgaacagttttatcaggaaatggtcaaagaatggaatcagaaatatccggatcgcaaaatcaagctgaataccgttgtttatccttatggacaaatgcatgataatttatcggtttcactgatcgcgggtgaggggcttcccgatatagcagacgtggaattaagccggttctcgaactttctgaagggtaaggatatcccgcttgccgatctgacgccgctgattgaaaaagaccgcgataagtttgtggaagcgcgtctggccttatacagcaaaaacggaaaattgtacggccttgatacacatgtggggacgaccgtcatgttttacaacatggatatcatgaaaaaagcgggcgttgatcccgcctccattaaaacatgggaagattaccggcgggcagggaaaaaagtgcgtgaagccgctgggaaaccgatgggaacggttgaaacaaacgactccgccacatttctatccatgatttcgcagcaagggtcaggctactacagcaaaaacggaaaattgattctgaacagcaagacgaatacagacacactgaattatgtaaaggacatggtaaatgataaaacccttctgccggctcccggcggcggccatcacagcgaagaatactacggttttatgaatcagggcggggcagcctcagtgctgatgcccatttggtacatgggacggtttatcgattatatgcctgatttaaaaggaaaaatggcgatttaccctatgccggcctggaaagaaggcggtgacagatcagcgggtttaggcggaacagccaccgtcgtgccgaagcaggctgaacatctgaagctcgcgaaagaatttctcggttttgcgaaaggttcgaaggaagggaatataaagctttggacggtgctcggctttgacccgctccgctgggacgtgtgggattcaaaagaattgaaggagaaaaacaagtacacggatttcttccggaacggtacgtcaattttttcctcgctccttgaaataaaagatgagatcaatccgatttatctgcatgaagacttctctaaagcggctgatctcgttgtcagacaagtgctgttcgatgcgctgaagacgcaggaaaaaacacctaaggaagccttggacgaggcggcagagcaattagagaaataggagaagccgccctatttaacagtgaaagcgggggagcttttatgagacctgtaaagacagagacagcgcaaaccgtttctgcagtccggaagaagccgcgccggtgcaatgtgctgtattcaaaaaaagcggcgccttatctttttacggcgccatttatcatttcgtttctcgttttctttttgtatccgattatcagcgtgtttatcatgagctttcaacggatactgccgggagaaattacatttgtcgggttttccaattataccgctcttcttaatccaaccttttatacggcattatttaacacattggaatataccttctggacgctgatcgtgctgattccggtgccgcttcttttggcggtgattctgaattcgaagctcgtcaggttcagaaatgtgtttaaatcggctctgtttgtaccggctttaacatcgacgatcgtagcggggattattttccgtctgatgttcggagaaatgaatacgtcgcttgcaaacgagctgatgatgaagcttggcgcatcaccccaaaactggctcaacaacaaaggtaccggcatgtttttaatggtactgcttgcgtcatggaggtggatggggattaacattctttactttctggcgggattgcaaaacgtgccgaaagaattgtatgaagcggctgaaattgacggggcgagtacgtggaaaaagttccggcatattacccttccatttttaaagccggtgtccgtttatgtgttaacgatcagtattatcggcggtttcagaatgtttgaggaaagctatgtgctttggcagaataattccccgggcaatatcggcctcacgcttgtcggttatttatatcagcaggggcttgcatacaacgaaatggggtacggggccgcaatcggaattgtccttttgcttgtcatcttactagtcagtcttgtttcactgaaactgtccggttcgtttaaaggggagggataagcggtgcgtaacaatcacatgttttccgtgtacagagtcgcgtttaccttgttttttatcatgctgagcctgttgtatatctttccgatgatctgcctattgctcggttctttaaagccgtcatctgagctgatgcgcatcgggctgaatctgcgccttgatccggatgtgatgagccttgataactacacctatttgttcaacggggggagcatttatttcaaatggttttttaacagcctgcttctcggcgttctcaccacggttctcacgctgtttttttcctctttgatcggctacggactcggtgtctacgaatttaaaggcagaaatattattttcgttcttgtgctgatcattatgatggtgcctcttgaagtgatgatgctcccgttgttcaaattgacggtgggtcttcatttgatcgattcttatacgggagtgattctgccgtttattgtgtcacctgtcgccgtgttctttttccggcaatatgcgctcggacttccgaaggatctgcttgattcagcgagaatggacggctgcaccgaattcggcatttttttcagaattatggcgccgctcatgaaaccggcattcggggcaatgatcattcttcaatctttaaacagctggaataactttttatggccgctgatcgtgcttcggtcgaaagaaatgtttacgcttccaatcggactttcagggctgctgagtccgtacggcaacaactatgacatgctgatttccgggtccgtttttgcgatactgccggtgatcatcatattcttgtttttccaaaaatacttcatttccggactcacagtaggcggagtgaagggatagagagagggaggaaatataatgaaaaaagcggggattacagcagataaagaatatatcatcggtgaagtggacaaacggatgtacggatcatttatagaacatatgggccgggcggtgtatgaaggcatttatgagcccggacacccgaaagccgacaaggacggcttcagaacagacgtgcaggagttaatcaaggaattgcaagtgccgttcatccgctatccgggagggaattttctctcgggctacaattgggaagacggcgtcgggccggtgaaggaccgcccgcggaggctagatttggcatggcaggcgacagaaacgaacgaagtagggacgaatgaatttttaacgtgggcgaaaaaagtgaacgccgaagtgaatatggcggtcaatctcgggacgagagggatcgatgccgcccggaacctcgtcgaatactgcaaccatcctgaagggtcatactggagcgacttacgaaaatcgcacggatatgaaaaaccttacggcatcaaaacatggtgcttaggaaatgagatggacggcccttggcagatcggtcataaaacggcgcatgaatacggacggctcgccgctgaaacggcaaaggtgatgaaatggacggacccgacgatcgaattggtggcttgcggaagctcaaacagcggcatgccgtccttcattgagtgggaggccgaggtgcttgagcatacgtatgagcatgtggattacatctcactgcatacgtattacggcaaccatgaaaatgatcttgagaactatttggcgaagtcgatggatttagaccattttattaaatccgtcacagccgtatgtgattatatgaaagcgaaaaaacgcagcaaaaaaacgattcacctttctttagatgaatggaatgtgtggtatcactcaaatgaagcggataaaaaagtggagccatggattacggcccggccgattctcgaagacatctacaattttgaagatgcgctgttgatcggttcactgctgattacgatgctgcagcatgcggacagactaaagatcgcctgtctcgcccagcttgtcaacgtaattgcgcctattatgactgaaaagggcggagaagcatggagacagccgatcttttacccttacatgcacgcctctgtctacgggagagggacttcaatgaagctgctgatcacctccccgaaatacgactcagcggattttacggatgtgccgtatgttgatgccgcggccgtttaccatgaagaggatgaagcactgaccatttttgccgtcaacaaaagcaaggaactgatggaaacggagatcaaactgagagggtttgaagattaccgcatcattgagcatatcgtgctggagcatcaggatatgaaagcgaccaatcaaaaaaacagaaatgaagtcacgcctcactccaacgggacgtcttccgcaaacgccgaaggaataacggctcattttaagccgctgtcctggaatgtcatccgtttatcaggaaaatagcgttccgaaaagccgggctgcgccgccggcttttttttacgcaaaaatcatctactgttatctgataattgtgataatatttagaaaaagagaaaaggggctgggattaaatgaatgcgattacaatcgtcatagcgtctatatgtattctggcgatcgcctatcggctttacggtacctttatgatggtcaaagtattaaaaatcaatgatcagacaccgactccggcccatgtgcttgaggatgggaaagattatgtgccgacgaataagtgggtgtcattcggccaccacttcgcggcaatcgccgctgccggcccgcttgtcggaccgattctggcagctcagttcggctatctgcccgggcttttatggctgttaatcggggcggtgatcggaggagccgtgcacgatattgtcgtattgtttgcatcaatgcggaaaaacgggaaaacgctttctgaagtcgccaaagaagagcttggcccggtggcgggcttttgcacgggtctttccatgctgtttatcattacgatcacgatggcggggctgtccatggttgtgctgcacgcgcttgagaaaaacccgtggggaacgtttgcggtggggattacgattccgatcgcgatgggggtcggcgtctactataaaaaaacgggcaatctcaaactcgcatcaactgtcgggtttcttttgttaatggccggtgttgtcatcgggccgcggctgcagacaacggctctcggggacatgctgacactggatgcgaaaacgcttgcagtggcgcttcctgtttatgcgtttttcgccgcggcgcttccggtttggcttttgctggctccgcgtgactatttaagcagttttatgaaaatcggggtttttgccgctttgatcgcaggcgtctttttcgtcaatcccgccattaaatttccggccgtaacggagtttattcacggcggagggccggtgatcgcgggtcctgtctggccgtttatttcaataacgattgcctgcggcgccatttcgggctttcatgcatttgtcggttccggcacaacgccgaaaatgctggataaatggagtgatataaagccggttgctttcggagcaatgcttgtggaatgtctcgttggaattatggcgctcattgcagctgccgctcttgagcccgccgactattttgctataaacagcacgcctgaaatattccgcaccctcgggatgaatgtcgtccatctgcctgaattgagtaaagaaatcgggctcagtctggaaggaagaacgggcggcgctgttacgcttgccgtcggaatgacgtatatctttacggagattccgtttttcagtcatttggcttcatacttttttcaattcgtcattatgtttgaagcggtgtttattttaacggcgattgatgcgggaacccgtgtcgcccggtacttgattcaagagtttttcggagaggtctataagccgctgaaaaaaacagactggctgccgggctcgattttctcaagcgcgctcgcctgcctgctgtggggctatcttctgtattcgggcgacatcagctccatttgggcgctgttcggcgtatccaatcagcttatggcgtctgtcggcttaattatcggtgcgaccgtcgtattaaaaatagccgataagcggcgctatatgctgacatgcctgattcctctcgcttatttgtacgtgaccgtcaactatgcgggttattggatggtgcggtatgtgtatttgaaccccgaagcggcgggatacaacgtgctgaatggcgttttatccattatcatgctcattctcgggcttgtgattatcattgcggctgtgaaaaaatgggcgaatgtatggcgtgatccgagtgccagactggaagcttcaatacccggataaatccgcggccgtccgaacattgcagcatcataaaaaagcagagagccgatcggtctctctgctttcatcttatgacaaatccgccgcttccaaaaggtaatccgccaaatgaaccgcgcggacacggcctgttaatccttcgcgtaaaatgccgagctgcatttgcagaaggcatccgggattggctgtcacgatgacggccgcctccgtttttccggcggctttcatcttactgtctaatattttcatagacatctctgactctgttatattataaattcccgccgacccgcagcagctgtcggccttttccatttctctgtactcagcccctttaatgcttttcaaaagcgtgcgcggttcctctgacgtatgcatcacattgcggagatggcaggagtcctgatatgtgacgatatgaggagactgcgcccgcaggtttttttgatggaacttcagatcaaccagtacggatgaaaagtctttgagcttccgggcgaattgttcggcacgttccgcccatccaggttcatctttcagtaaatgcggatattcctgaagaaaggcgccgcatccgccggcgtttgtaatgatataatcagcgtcaagcgcctcaaaagccgcgatattccgcttggccagttcttttcccatctctttttctccgctgtgcccgtgaagcgcgccgcagcacgcctggccgtccgggaccgcgatttcacacccggccgcctgtaaaagcgccgttgtcgcatgatttgtcgctaaaaacatcgtatccattaagcagcccgagaaaaaagcggcccgtttttggacgggacccgcggcaggaagaaaacgcggcctttccttcatgtctttccgtttcggggcgggcgggagcacttgttccattgtgcgcagatgttcaggcaaaacgcgcagcataccggtttttctgacggcggtctgcagtcccgatctttggtatattccgagaagattcacggctgtctgcatgcggttttggtgagggaaaagcccggtgaaggcggctttccgcaagagacgcacgcccggcttatgttttttattttgatgaatgatatccctcgcttcttcaagcagctgtccgtaattgacccctgccggacaaacgggctcgcatgcccggcatccgagacacagcgaaagtgagcgctcgacatcttcatccggctcgatcagtccgtctgtgacggctttcatcagggcgatccggccgcgcggcgaatgggattcttgaaatcccgattcaatataggtcggacaggaaggaaggcagaagccgcagcgcatacagttcagcaattcaccttcatccatgcggtttttgaattctgtttgaatttgttgctgctctttagccgttgtcatttcatcaccaccacgcgtttccttgatgaattggcgaatatttttcccggattcagcagattttggggatcaagcgcttgtttgatcgctttcatggcggtgatgccttctgttttcagcttcatttctaaatacggcgcttttacgatgccgaccccgtgttcacccgttatcgtcccgcccagctcaatcgctctttcaaaaatggcggcaaaagctttttcgacacgttccatctcctctgtatttcggatatcggtggtgcatgtcggatggaggttgccgtctccggcatggccgaatgtgcagatggacaggccgtatgtttctgcaatctcgttaatggctttgaccatgctggcaatttgtgatctcggcacggtcgcatcttccagaatcgttgtcggtttcagccgggcaagggctgataatgcggaccgtctggcctctgtaagcgcgaatgcctcttcctcggtttcagccgtttggacggatacggcggctccgtttttacaaatcgcttcgattttttccatatctcgtctgaccgtttcggtgtcaccgtcctgttcgatcagcagcaccgcttttgcgtcggtcggaagcccgatcttggcgtaatcttcaatgacctgcagtgtcggctgatccagaaattcgagtgtcgccggaatgattttttcagcgatgatggcagaaaccgattccgcagccgcttcaatatgttcatagagtgcaagcagcgtttttttcgtttccggcttcggaaccagctttaaagtcgcttccgtcacaacgccgagcgtcccttctgatccgacgaaaagccgggtcagatcataaccggcgacatcctttgtcagctttcctcctgtgcggatgatatcgcctgaagccaatacggcttcaaggccgaggacataatcccgggtgacgccgtacttcaaaccgcgcagcccgccggaattttcattaatattcccgccgattgtcgatattttcatgctgctcggatcaggcggataaaataaacctttttgttcaaccgcacggatcatatcttgcgtaatcacgcccggctggacggttgccgtcaaattttcttcatcgatttctagaatgcggttcatatgtttgaataaaagcacaagcccgccttcagacggacatgtgccgccgcacaagtttgtgcctgaacccctcggcacgatcggaatgtcatgcctgctgcaaatcgttaatatacgggacacgtcattcgcactgcggggggcgattaccgcatccggcatggcttgcagctgaggagccgcatcataagaatacacaagacggcccgccgccgaatcatcataattctccttcccgaccgtccggatgaacgcttcttttgcctctcgtgaaatcatgttctcccaacctccctgataagaaaagcgttttcatttaattgtaaagaaaaacgattccgcacactatggagaaacatatgaaaaatgttgatatgattacgtgctttttgtatgttgatctaaaaagcgcagcgccaaataaaaagccgctatgtcttcagggcggtccagcttcatatttgtcagtgattccagtttggaaagacggtagcgcaatgtgttgatatgaatatgcatgtcgtcggcggtgcgctttaacgataattgccggtcgaaaaaggcgcgcagcgtatccagaagttcttcccggccgagtacatgctcgagaacccgccgtgaaaattccgacctcgtgcggggtgtgatatcggcaagacacatatccagttttaaatcttcttcaaagacggcctgcttgtcaccgattccggctgaaagtgctttatctgcctgttcgtatgattccgtgaggcgctctcccggaacgatccgtccgatgccggcggtgacaggctgcccaaaaacggcgccgatctttttaatgagctgtgttttggaagccgaatttgcttcatgattaatgagaatgcgttcatttccccagcggacaaacaggtcttcagggcattcgtactgccagagccgcccgagctcctccgctttatattgctcataacggccttgaatgagtatgatccggcggtatgcatgaaggtctgcgccgatgagctttgctttttctaaaaagcccggagaccattctttcagctgcagccaatcaaccataaaggattcaagcattctcgcacgccactgcgcttcttccatatggcgcgtttctttaataaacagctccgtcatttttctgagcaattctccgaaaggcaggatatcgtcagggtctcctgtcaggccgaatactccgatcacttcatggcctgaaaaaacggggaggttcagtcctgcttttacgccctcgagccgtttttcatcttctttcgtaatgatgacattccgtttttcgcgcgcgcagatcagtgcgccttcatgaaaccatccggcgcgcgcctcgttggtgcccgcgatgatcatcccttttgtatcggcaataatcacttcgcggctgtacatatgtttgacttcggcaatcaatttctttgccagttccggctgtaactgcatggcgatccccctcgccattattatacaaaaaaaaccgggtgtcccatcacccggttcatgcttattgcgcaggttttaatccgccttcaagtgttttgagcatttcatttttttctgagtccgacgcatgctgccaaagaacttcgaataagacgccgaggcccggaagcattttttcttcaccgctttggatggcgtcaacgatcgtatgctccagctgatcctggttattgccggttacattggcaataacggcgttgcgtaaattaagatccattacaaccgctcctttttctgaatgtgatacgcatattcttaccgcgcacgcggtttattatgtgctgttcttaagatataataacaacatgcatgaaaaaaggagagcacagacataaagtgaaacgaatcgactctgcaaaaaaccaaaaagtgaaggactggaaaaaacttcacacaaaaaaagagagacttaaaacgaatacatttctgatagaaggagagcatctggcagaagaagcgctcaaatcaaagggaacggtaaaagaaattctcgtaaacgatgagagcgccatcccggccgatctggacatgagcattccgtgctacgtgctgagcgaagacgcgttttcagccgtgacggaaacagaaacgccgcagcggatcgccgcggtctgccatatgccggataggcagcctgatcagctgaagcggctgcttctgattgatgccgtgcaggatccggggaatttaggaacaatgatcagaacggcagatgcggcgggaatcgacgccgttgtccttggtgagggaacagcagacccgtacaatggaaaaacgctgcgttcagcacaaggttctcattttcatattcccattttgaaacgtccgcttgatgagtttaccgttgagctgaaatcacaaggcgtcgcgatctacggcacggcgcttgaaaacggtgcggcttatcaaagtgtgaagcctgaagaatcgttcgcgttaatcgtcgggaacgagggggcgggagtggacgccggccttctgcaaaaaacggatctcaacctgtacgttccgctgtacgggcaggcggaatcgctgaatgtggcggtagcggccgccatcctcgtttatcatctcagaggataggttgcgaaaagccttggatttcactataatagatagcaataatgtaaaaaccgtgacagaggacgtcaatttttgcacacactgccttccagggagaaaatgccgctgactgaaagcatttttatcgcagcacaaaaattgattttcacctctcgagttgtcaccgggaccgcgccaaacgcgcgtaaaggtgaaccggaacgatcgtttccgttatgtcaatgaagctgtcggcagatgaagtctgccttaaaaagggtggtaccgcggccacaactcgtcccttctctcaaggggcgggtttttttgttttctgaaaaaggcatagaacggtttggtttacataaaaggaggatgcatgatggaagagaagcttaaacagctcgaactggaagctgcagaaaaagtagaagcggcgggttcattaaaagaagttaacgacattcgggtgcaatatctcggaaaaaaagggccgattacagaagttctccgcggcatgggcaaactgtccgccgaagagcgcccgaaaatgggagcgctcgccaatgaagtgagagagcgcattgcagcagccattacggcgaaaaatgaacagcttgaacaagaagagatgaataaaaaactcagcagccagacgattgacgtcacattgccgggcagtcaggtaaacatcggcggacgccatccgctgacggtcgttattgaagaaattgaagatttatttatcggcatgggatataccgtcgaagaaggccctgaagtggaaacggattattacaactttgaggcgctgaacctgccgaaggaacatcctgcccgcgacatgcaggacagcttttacattacagaagaaatgctgatgagaacgcagacgtcaccggtgcagacgcgcacgatggaaaagcataaaggaaaaggccctgtcaaaatcatttgtcccggtaaagtgtatcgccgcgacaacgatgacgcgacacattcccatcagttcatgcagatcgagggtctcgtcgtcgaccgcaaaatcagcatgagcgacctgaaaggcacgcttgaattggtcgccaaaaaaatgttcggccaagaccgtgaaatcaggctccgtccgagctttttcccattcacagagccttctgtcgaggtggatgtgacctgctttaagtgcggcggacaaggctgctccgtctgcaaaaaaacaggctggatcgaaattctcggcgccggcatggttcacccgaacgtgctgaagatggctggattcaatcctgaggaataccagggtttcgctttcggaatgggtgttgaacgtatcgcgatgctgaagtacggcattgaagatatccgccatttctataccaatgatgtcagattcatttcgcagtttaaacaggcgtaagaggaggatacacatgtttgtttcttataaatggttagaagattacgttgacttgcagggaatcgatccggccgtgcttgcagaaaaaattacgagagccggtattgaagttgagggtatcgagtataaaggggagggcgtaaaaggcgttgtcatcggacacgtgcttgagcgcgaacagcacccgaatgccgacaaactcaacaaatgccttgttgatatcggtgcggaggaacccgtgcagattatctgcggcgccccgaatgttgagaaaggacagaaggttgccgttgcaacggtcggagccgtgcttcccggcaatttcaaaattaaaaaagccaagctgcgcggcgaagcgtctcacggcatgatctgttcccttcaggagctcggcattgaaagcaagctcgtggcgaaagaatatgcggaaggcattttcgtttttccgaatgatgctgaaacgggagctgacgcaatggcggcccttcagcttgatgatgcgattttagaattgggtttaacgccgaaccgcgccgacgcgatgaacatgctaggcgtggcttatgaagttgcggctatcctcggcgcagaggtaaagcttccggaggcttcatatgaaaaagcggcaggaaaagcggcggatgctgtttccgttaaggttgaagatacgcaggccaatccgcattatgccgcaaaaatcattaaaaacgtcaaaatcggcccgtcaccgctttggatgcagacgaagctgatgaatgcaggcatccgcccgcataacaacgtcgtggacattacaaacttcgtcctccttgagtacggacagccgcttcacgctttcgattacgaccggttcggttcaaaagaggtcgtcgtcagaaaagcggcggaaaacgaaaccatcgtaacgctggatgaacaagagcgaaagctgtcaagcagccatttggtcatcacaaacggaaaaaaagcgcaagccgttgcgggagtcatgggcggagctgagtctgaagtccgtgaagacaccactgcgattttactggaggccgcttatttcgacggacagaccgtccgcaaagcgtcgagagacctcggattgagaagcgaagcgagcgccagatatgaaaaaggcattgatccggcccgcgttttgctggcggctgaacgggcctgcagtctcattcaggcatatgccggcggagaagtgctctcaggcacggttgaagaaaaccatctgaaaattgaagcaaacaatattcacgtgtctgttgaaaaagtgaacgccgtgctcggcatgacaatcgctaaagaagaaatcatcagcatttacaagcgcctcgggtttgcagtcggtgaagctgaagacgttctcgtcgtaacggtgccgtcgcgccggggagatattagaatagaagaagacctgattgaagaagcggcgagattgtacgggtatgacaatattccgtccacgcttccggaaacggccggcacgacaggcggcttgacaccgtatcaggcaaaacgccggaaagtgagacgtttccttgaaggagcgggtctttcacaagcgaccacttattcattaacgaatgataaaaaagcggccgcttttgcgatcgaaaaatcattcaacacgatgcttgctctgccgatgagcgaagaaagaagcattctcagacacagcctcgtgccgaatcttcttgaagccgtttcatacaatctggccagacagactgattccgttgctttatatgaaacgggttctgtatttctgacgaaagaagaaaacacaaaaccgattgaaaaagaacgggttgccggagctgtaaccggattgtggcgcaaaaatttatggcagggtgagaaaaagccggttgatttcttcgtcgccaaaggaatcgttgaaggcctgctgcatcaattgaatgtgtcagaccgggttgaatttgtccagtcagaacgcaaaaacatgcatcccggccggacggcaaacattctattgaacggttcgcttgccggatttatcggccaggtgcatccggcaatggaaaaagagctggatatcaaagaaacgtatgtgttcgagcttgatctgcacgcgcttctgaccgaggaaacagaacctgtcgtgtatacgccgattccgaagtacccgtccgtcacgcgcgatattgcgcttgtggcagataaaaccgttacaagcggacagcttgaagccgtgatcaaagaagccggcggcgcgctgctgaaagaagtcaccgtgtttgatgtgtacgaaggtgagcatatggaagaaggcaaaaaatccgtcgccttctcgctccaatatgttaaccctgaacaaacattgacagaagaagaagtgacaaaagttcatgaaaacgtgctgaaagcgctggaagaaacgtatcaggccgtattaagaggataaagaaaaagcttgcagatcactctgcaagcttttttattatgaccgcttccgttcaacaaggcgtttcgctttttgcgtattggcaaaatgaagtttggtgaacgttctgagcgcaccttctcccttattgatgatcagcttggcggcagcttcatcgacatgcggccccgcgcctttcggaatcgtcatcccagcctcacgggaaagcttatccatttcaattaagaaagaatatcgcgcaatgatagaggctgcggcgacggaaagatgtatgctttccgctttcgtgctgaaaaacgttttttcttttacgatatcccgtccggaaagatgcttaaaataaatgccgggctctgcgaattggtcaatcagaatcgcttccggtttaacgccgttcatttttctcagcagattggaaatcgcctgattatgaaggagcgccttcatttttccttggctcatgcctttttcctgcatctgattgtatttttcgttttttaacacaagcaggctgtaaggaatggttttaattaacagtttggcgatttcaataatctgcggatcttttaaatccttcgaatccttcacaccgagttctttcattaaagaaagctttgatttgtcggcgtaagcgcaggcaaccgttatcggcccgaagtaatcgcctgttccgacttcatcagagccgatcactgacatggaggcaatgcccgccgggggagcgtagagcgggtcggccgcttttttgacggttttctttgctttcggcgcctcagccgttccccagcgggccgcttctgtgccggcgttttttccttgaaagagaaccttgcccgagcggtaggctgtaatggtacagcccggaggcttagcctggaagacggcacccttcggaacggcgggagtaagggagccggcataggattgtttcatttgttccatagcggaagcggatacttttataacagaatgggacacgatataatctccttttttggcacttttcactgtatataccagtgtatcataacagcccgaggctcgtctttccattcaaacgataatcgtggtatgataggaactaggattctcgcggaatggaggagaaacgttgtctgacggcaaaaaaaccaaaacgacagtaaacatttacggccagcacttcaccattatcggggaagaaagcaaagcgcatatgcgccatgtggccggagtggttgatgataaaatgagagaaatcaacgagaaaaatccatatcttgatataaataagctcgctgtattgactgcggtcaatgtcgtgcatgattatatgaaactgcaagaaaaatatgaaatactggagcggcagcttaaagaaaaggaatgaacaccatatgatagatatcatcatcttagttctgctcttaatgggcacattgcttggattaaaaagaggatttatcctccaatttatatatttaacgagtttcatcctctcgattgcgtttgcggcgcttttttacaaaaacctggccccgcatctgagctttatacccgcgcctgatttttccggcgggcaggcggctctgtcttttattaaaggaaacgtagagacggcttattacaacgcgatcgcgtttgtcattttgtttatcatcgcaaagattctgcttcggattatcggagcggcgcttaatattatcgccggcattccggtcattaaacagatcaataaactgctgggcggggtgctcggatttctggaagtctatttatttgcgtttatcctgttatacgtcgcatccgtactgccggtaagcgcgcttcaggatatgctcgcacaatcgacgcttgcaaatatcatcacacatcatacgccgtatctgtcagggctcctgcaagaactgtgggcccagtacggggcataaaaaacttctcttgaccggagaagtttttttcaagctctgcgtcagttgtgccggaggagaaaaatttgtatgatgagaagcaggaaacgactgggggttaacagtatgcataaaaaagatatcatcaggctgcttgaaacgattgcggtctatatggaactgaaaggggacaacccgtttaaaatatcagccttccgaaaagcggcagcggcgcttgagcaggatgaccgcagcctgtcggaaatcgacgacatgatgtctttatccggaatcggaaaaggcacctacggcgtcattcgtgaatatatgcaggaaggtgtgtccggcacgcttctccaattgcagaaagaagttccggaaggcttggttcctcttttgaagcttccgggcctcggcggcaaaaaaatcgccaagctgtatcaggaactgggcgttcatgacgcggaatcgctgaaagaagcatgcgagcagcaaaaagtacaggggctcgccggtttcggcaaaaaaacggaggagaaaatcctccaggctctcggagaagccggaaaacagccggaacggtttccgatcggctatgcgctcagcattgcttcagtaattgaagaacatttggcccggctgacggatattcagaaatattcccgggccggcagtctcagaagagcgcgggaaaccgtaaaagatctcgattacattatcgctacagatcatccggaggctgtcagagaacagcttctttccctcccgaacgtaaaagacgtgatagcgagcggggatacaaaagtatcagtcatcctgacctttgaatatgagacgagtgtggatttccggcttgtgacagaggaacagtttgccaccacactgcatcattttaccggttctaaagatcacaacattaaaatgcgccagctggcgaaagagcgcggtgaacggatcagtgaatacggagtagaaaccatggaaacgggagacgtcaaaacattcccgagcgaagaagcgttttacgcccacttcggtctgccgtttattcctcctgagctcagagaaagcgggcaggaggtcgacacgtaccgggaagaaacggatcttgtggagcataaagcgataaaaggcgatctccacatgcactcagcctggagtgacggcgctttttccatcagagaaatggcagaagcgtgtatggcaaaaggctatcagtacatggcgatcaccgaccattcccaatatttaaaggtagccaacgggttaacggccgaacggctcaaaaaacaggcggaagaaattgacgcgttaaatgctgaatttgaaaattttcatatttttaaaggcgtagaaatggacattctccccgacggttcgcttgattatgatgacagtgttctgtcggaaatggatcttgtcatcgcgtctattcattcaagcttcagccagccggagcatgtcattatgaaacggcttgaacaggcgctgacgaataagcacgtggacattatcgcccacccgacgggacgcctgatcggcagacgggccggctatgaagtcgacatcgacatgctgattgaactcgccgccaaaacaaatacggcgcttgaactgaatgcaaaccccgcgcgccttgatttacggactgagcatctgatcaaagcaaatgaaaaaggcgtgactttggtcattaataccgatgcccataatatcgagatgctcgatgatatgaaaacgggcgtgaccgcagcgcgcaaagggtggacggagacaaaacatgtgttaaacgcccggccgctacacgaggtcaaagcatttctgacgcgcaatgattaagtaaggaggatcacaaaaccgtgcagcaaaaagtgttatcatcacttgaatttcataaagtaaaagaacagattaccgcacatgccgcctcatcgctcggccgggagaagcttctgcagctgaaacctttgacggatctctcagacatccaaaaacagctggatgaagtcgaagaagcatccgcggtcatgcgcttgagaggccatgctccgttcggcggtctgaccgacataagatccgctttacggcgggcggaaatcggcagtgtgctgacgccggcggaattcaccgaattgtccgggctgctgtatgccgttaaccaaatgaagcattttatcagccaaatgacagaagacggcgtcggcattccgctgatacaggcccatgcagaagaactgattacattaggcgatttggaaagggagattaactcctgcattgatgaccatggtgaagtgcttgatcatgcgtctcctgctttaaggggaatccgcacgcagctcaggacgcttgaatcaagagtcagagaccggcttgaatcgatgctgcgttcatcttccgcttctaaaatgctgtctgacaccatcgttacgattcggaatgaccgctttgtcatcccggtcaaacaggaatacagatcaagctacggcggaattgtccacgatacatcttcatccggtgcgacactgtttattgaaccgcaggcgatcgtagatatgaacaactcgcttcagcaggcgaaagtaaaagaaaaacaggaaatcgaacggattctccggatgctgacggagcatacggctgaacacacacaagaaatcgctcaaaatgtggaagtgctgcagacactggatttcattttcgctaaagcgagatacgcaaaagcgatgaaggcgacaaaaccactcatgaacggagacggttttatccgtcttaaaaaagcacgccatccgctgctgccccaagatcaagtcgtggccaacgatattgaactgggcggagattactcaacgatcgttatcacgggaccgaatacgggcggtaaaaccgttacgttaaaaacactcgggctgctgacgataatggcgcaggcaggattgcacataccggctgatgagggatcggaagcagccgtatttgacaatgtgtttgccgatatcggcgatgaacagtcgatcgaacaaagtctgagtacgttctcatcccacatggtcaatatcgtcaatattttaaaagacgtgtctgaaaacagtcttgtgctgtttgatgaactcggtgccggaacagatccgcaggaaggagcggcgcttgccatgagcatccttgacgaagttcaccggacaaacgccagagtgcttgcgacaacccattatccggaactgaaagcatacggatataacagacaaggcgtcatgaatgccagcgttgaatttgacattgaaacgctttcgcctacctataagcttctgatcggagtgccgggccgaagcaacgcatttgaaatctcaagacgccttgggcttccggagcatatcatcggccaggcgaagtcagaaatgaccgccgaacataacgaagtcgatctgatgatcgcatcgcttgaaaaaagcaaaaaaagagcggatgaagagctttctgaaaccgaatcaatcagaaaagaagcagaaaaactgcacaaagaacttcagcagcaaatcattgagctaaacgcccaaaaagataaaatgatggaagaagccgagcagaaagctgcggaaaaactggaagccgccgcaaatgaagccgaacagatcatccgcgagctcaggtccatcaagcaagaacacagatcctttaaggaacacgagctgattgacgccaaaaaacgtctcggagacgcgatgccggcttttgaaaaatcaaagcagccggaaagaaagacagagaaaaaacgcgagctgaagccgggcgacgaagtaaaggtgctcacattcggacaaaaaggggcgctgcttgagaaaaccggcgagaaagaatggaacgtccaaatcggcatcctcaaaatgaaggtgaaggaaaaagatcttgagtttctcaaatcggctcctgaaccgaaaaaagaaaaagcaatcaccgccgtaaaagggaaggattatcacgtatcccttgaacttgatctcaggggagagcgttacgaaaacgccctcagccgcgtcgaaaaatatttagatgacgcggtgcttgccggctatccgagagtgtccatcattcacggaaaaggcacgggcgccctccgaaaaggggtgcaggatcttctgaaaaaccaccgcagcgtgaaaagctcgcggttcggggaagcgggagaaggaggatcaggcgtaacgattgtcgaactaaaataaaaagggagtaaacgtcatgaatgctttttgggaaaatgagcttgttgaaatcgcggcttattacagtgtagccgtcttgtgtctcgtcatttttctgaccgtgtttgaattggtgacatcctataaaaactgggtggaaatccaaaaaggcaatcttgcggtggcaatggcgaccggagggaaaattctcggtatcgcaaatgtctttcagcacagcatcgcccagcataattcgcttttgcaaatgatcggctggggcgtatacggatttattatgcttttaatcagctattttatctttgaatttctgacgccccggtttaaaattgataaagaaattgaaaaagataacagagctgtcggctttatttcatttgtcatctcagtcggcctgtcattcgtggtggccgccgggatttaaggggacggggaaaaatggagaagcttgcgaaagtgctgctgtcggcagcgggaatttttctgttcatcggacttatttatctggtcatgacatcttaatactgaaaaaaggctgccgaactagaatcggcggccttttttattgagaataccagtttatgcaggccgtatcagagcaaatgacggcttcccaactcatggcgcggatgacagacggcatgtcttgatcttccatgagaaagagtgtcgtaaaagaatcatatatgctcataaaagcggcgcgccgtttttcgtcggcaatgatcatgtcagcccgcagcaatccgcatacatccgaagccgccgtttgattgagtgaaaatatgcctttctcttcgaccggctcataataagtgcagcgctttatgccttttgaacggaacacatccaaaagtcccggtatcaaaaatggcgaagtgacatcatcgctcggcaagtacagatcgggatgatgaagccgatttaacagctcggcggattcaggatgtgcatattcatcccgaagtgccatgacagcgctcataagcgcaagcgccgtctctttttcagagcgcaatccgcaaacggtcatgacggatttccaggaaacgggtctgcccatcgcgatgatctcctcatcactcggatatatatgttcataaggccgtttgcgcttttgctcttcccacccatcaggcatccggacaaagggatgaagcaaaaaggcggccgacgtaaacggcttcggcagctggcgcaggataggaactccttcttcaaaatgcagcgtttccagcaagctcaacacctcctgaaactcgaaatttcacatgaaacgctttcccattccaatcacccttctgctataataatagcgtataggaaaacagaagggagaggtattatgcagtctgaaaagccatggctttctcaatatcccgaagagattccgcatgagcttgaatttaccgatcaaaccctgccatccaatctgacaaactccgcagctcaattcccgaaccataccgccatttattttctcggaaaaaaactcacatttcaagacgttctcacagattcgttaaagctagccgcttttttacgcaaaacaggcctgaaaaaaggtgacagagccgccattatgctgcccaattgtccgcagtcggtcatcgctttttacggcgtattgtttgccgggggcattgtcgttcagaccaatcctctctacacggaacacgagcttgagtatcagctgaaagacagtgcgccgcgcgtgatcatcacccttgatatgctgtttccgaaggtgataaaaatgaaaacgttatcaatcgtcgaacgcattattacaacaagtataaaagactttttgccgtttccgaaaaatatgctgtatacgctcacgcaaaaacaacaggtgcatattgattatgacggctgcgaacaaattcacaaattagcggatattttaaaaaacgaaagcgcggaggaggcagagccatttgatattgaccctgcgcatgacatcgccgtgcttcaatacacgggcggaacaaccggctatccgaaaggcgtcatgctcacacaccggaacattcaggccaatacagaaatgtgcgccgcctggatgtacaaaatgaaaaagggagccgaaaaggtgctcggcatcgtgcctttttttcatgtgtacggattgaccgccgtgctcaatttttccattatgcagggatgtgaaatgatccttcttcctaaatttaatcctttggataccctgaaaacaatcgacaggctgaagccgacggtttttcccggggcaccgacgatttacatcgggctgttgcatcacccggagctgaataagtatgatttgtcctccattgaaagctgtccgagcggttcagcggcgctgccggttgaggtcaaacagaaatttgaaaaagtgaccggaggaaagcttgtggaaggctacggattatccgaagcatcaccggttacccattcaaacttcatttggggaaaaaataaacccggcagcatcggctgtccctggcccaataccgacgccggaatctattcagaagaaaaaggcgggcttgcggggccgtatgaacacggcgagctgatcgtaaaaggccctcaggtcatgaaaggatactggaataagcaggaggagacggcgcgtgtcatcagagacggctggctgtttaccggagatatgggatatatggatgaggaaggatttttctacatcgccgacaggaaaaaagacatcatcattgccggcggatacaacatttacccccgggaggtggaggaggcgctttatgagcatgaagccgttcaggaaatcgtcgtagcgggcgtccctgattcctacagaggggaaacggtgaaagcatttatcgttttgaaaaaaggcgccgaggcagatgccgatgagcttgatgcgtttgcaagagagcggcttgcgccgtacaaagtcccgaagctttacgaattcagaaaagagcttccgaaaacggccgtcggaaaaatattaagaaggcgtttagtcgaagaagaagatgcttcccgtgaaaacaaggtgccttaaaagaaaaacttgacaaaatccggattcctttttatcatgaagttatgaatgaatagtcattcatttatcgaaggaaggaacgatgacattgaaccaaaaacggccaaagtatatgcagattattgatgcagcagtagaagtcatagcggaaaacggctatcaccaatcacaggtgtccaaaatcgccaagcaggccggcgttgcggacggcaccatctatttatatttcaaaaacaaagaggatatactcatttctctttttaaagaaaagatgggccagttcattgaacgcatggaagaagaagtgaaagaaaaaacgacggcaaaagaaaaactcgccctcgttattaagcagcatttcacactgctcggcaatgaccgccacctcgcgattgtgacccagcttgagctcagacagtcaaatatcaagctgcgcctgaaaatcaatgatattttaaaaggttatttaaacatgctggacaccattttgaccgaaggaatcaagtcgggggaatggaaagacaatctcgacgtccgcctcgcccggcagatgatattcgggacgatagatgaaacagtgacaacatgggtgatgaacgatcagaaatatgatcttccggatttgtcagacaaggtattggagctgttggtgtcagggattcatcaaaactaaagggggttgacggatgaacagcctttcgatggcggtagaacaatctgttgcggtgattaccattaatcatcagccggccaacgcgctatccggtgcggttttagatgagttgtccggtctgttcgaccgatgtgaaacagatgacagcgtcagaagcatcatcattcgcggtgaggggaaatttttctcggcgggcgccgatataaaggaatttacgtcgcttgaaaatcttgagcaatcttctgccatggcggataaaggccagcagctgatggaaagaattgaagggtttccgaagcccgtgatcgcagcgattcacggcgctgcgctcggaggcggccttgagctagccatggcctgccatatcagaatcgctacattggatgcaaagctaggcctgcccgagctgaatctcggcattattccgggctttgccgggacgcagcggcttccccggtacgtcggtacggcgaaagcgcttgaaatgatcggcacttcagaacctgtgtccggagaagaagcgctcagcctcggtcttgtcacgataggcgccgaacatgaggaagagctgctgaaaaaggcgaaaacgctcgcgggcaagtttgcggaaaaaagcccgcagtcgatggcttatctgcttgagctcctttattcaaataagatctattcttatgacggcggcttaaagcttgaagcaaagcgctttggggaagcatttgcatcagatgacgcaaaagaaggcattcaggcatttctcgaaaaaagaaagcctcaattcggtgggcgaagataaaggggataaaaatatgaatctatttgtactgatgaaacggacgtttgacacagaagagaaaatcgtcattgaagcaggaaagattcaggaggacggggccgaatttatcattaatccgtatgatgaatacgccattgaagaagccattcagctgaaggaagagcacggcggaagcgttaccgccgtaaccgtcggcggagaagatgcggagaaagaactgagaaccgcccttgcgatgggctgtgaccaggcggtgttaatcaatattgaagatgatctgagcgatcctgaccaatactccatttcaactatcttatatcattatttcaaggaccgggaatatgatctgattctcggcggaaatgtcgcgattgacggcggttcaggccaagtggctccaaggcttgccgaactgctgaacattccttgcgtcacaacgatcacaaaactgacaatcagcggcgatgaagctgtggcagagaaagacaatgaaggggataccgaaatcattaaaacctcacttcctttagtcatcacggcacagcaaggcttaaacgagccgcgctatccgtcgcttccgggcattatgaaggcgaagaaaaaaccgctggaagaacttgagctcgatgatctcgacattgatgaagatgatgccgcaccgaagctcaaaacgatcgaacgttttctgccgccgcaaaaagaagcgggcagactgatcgaaggagaagccgctgagcaggcgaaagagcttgtgtcactgctgagaaaagaagccaaagtcgtataaaccgatattaaagaaactgggggatgtcagaatgggaaaaaaagtgatcgtactcggagaaattcgtgacggcgccttacggaacgtcacctttgaagccatagccgcaggcaaaaccatttccggcggaggagatgtcatcggcgtgctgatgggaaaaggcgcagctgatgcagcaccagaactcattcagtacggcgccgacaaagtatttacggccgattcgccggggctttctcagtatacggcggacggatatgccgcggttctcggggatttgatcgaaaatgaaaagcctgatgcggtcattttcggccacacttctatgggaaaagatttgtcacctaagcttgcggcccggtttgaaacggggctgatttcagacagcacggatgtaagcgttaccggagacaacatcgtttttacaagaccgatctattccggcaaagcctttgaacaggtgatttcaactgatccgttcattttggcgacgattcgtccgaataatattcaggcattagaaaaagacgcgagccggacgggtgatatcgaagagcttgcggcgcctccggcagatttgcggacggtcattgaagaagtagtcaaaaaaacggcggacggcgtggatttatcagaagcgaaaattatcgtagcaggcggccgcggtgtaaaaagcaaagatggatttgaaccgttaaaagaacttgccgaggtgctcggagcagcggtgggcgcttcacgcggcgcgtgtgacgcggactattgcgattattctcttcaaatcggccagacgggaaaagtcgtcacgccggatttgtatatcgcctgcggcatttccggagcgattcagcacttggcgggcatgtcaaacagtaaggtcattgttgccattaacaaagacccggaagcggaaatatttaaaatagcggactacggaattgtcggcgatttgttcgaagtggttccgcttctgacgcaggaatttaaaaatgccaatattcattcataatcataaaccctctggcttatttgtcagagggttttaatttgtgttaattggttcgtacaaattaaaggttgataaaataagagattgacatgtacgaaccaatataataagcttttgtaaagcgcttacaaacttatccattcagcatacatcccagatacatagatcggctgtagtgctttcattcttattaagggaaaggaatgatcaagtttgtctcacaatacggcagtcattcaaactgatatcacacggggaaccattaataaaaacatatacggacatttcgcggaacacctgggaagaggcatatatgagggcatctgggtcggaaaagattccgatattccgaataccggcggggtcaggacggatgtcgccgccgccctcaaacagcttcagattcccgtcctcagatggccgggcggctgttttgcagatgaataccattgggcaaacggcgtagggaaacgcaaaaccatgctgaatacccattggggcgggacgattgattccaatgaattcggcacgcacgagtttatgatgctttgtgaactgctcggctgcgaaccgtacatcgccggaaacgtcggcagcggaacgattaaagaaatggctgattggattgaatacatgacgtttgaagcgggcacgccgatgtccgactggagaaaagaaaacgggcgggaaaaaccgtggaagctgacatatttcggaatagggaatgagaactggggctgcggcggaaacatgcatcctgagtattatgccgacctttacagaaactttcaaacctatgtccgcaattacagcggtaatgaaatctataaaattgccggcggcgcgaatgtcgacgattaccgctggactgaaactttaatgaaaaaagccgctgatctcatggacgggctgagcctgcattattacacaataccgggcgacttctggaaggggaaaggatcagcgacggagtttacggaagatgaatggttcatcacgatgaaaaaagcggcgcatatggatgaattgatcacaaggcacagcgccatcatggatcagtacgatcccgaaaaaagagtcgggctgatcattgatgaatggggcacgtggcttgatcctgagccaggcacgaatccgggctttctgtatcagcagaatacgatccgcgacgcccttgtcgcagccacgcattttcacatttttcatcagcacgcagaccgcgtacagatggccaatatcgcgcaaaccgtcaacgtgcttcaggcaatgatcctgacagaagggaaagacatgctgctgacgccgacgtatcatgtgtttgatatgtttaaggtgcatcaggacgcttctcttttggcgacagaaacaaaagcagccgggtacgaatggaatgacggccggctcccgcaagtcagcatttcagcgtccaaacagcaaaacggagacatacatatcagcctttgcaatatcgatcatctgcacaaagctgatgtgaagattgaactgcggggcatgaaaaaggcagggaagccttcgggaacgattctgcacgcggaaaaaatgaatgcccataatacattcagcagtccggaaaacgtcaaacctaagccgttttccgggttttctcaaaagggcggaaaacttgaggcggagcttcctccgatggcggttgtactaatcacgctgcctgcgaatccatcttaagttttgaacgcctgccgcccggttataatacactgtataaataagattattttcggcgggatcgggagaaaataatataagcattaaattagcatgaacgaatgggagatgctatactaaaaatcatcatttgacaattggaggaataacaaatggctatcgtaaaagcaactgatcaatcgttctcagctgaaacaagtgaaggtgtcgtattggctgatttctgggctccttggtgcggaccttgtaaaatgatcgcgcccgttcttgaagagcttgatcaagaaatgggagacaaactgaaaatcgtcaaaatcgacgtggatgaaaaccaagaaactgccggtaaatacggcgtcatgagcatcccgacacttctcgtattgaaagacggagaagtcgttgaaacatctgtcggtttcaaaccgaaagaagctcttgaagagcttgtaaacaaacatctgtaagccgaaagcttccgttacggcagggcgattcctttgaagggaatcgcctttttttgaccttccaaaagctgagaatggagaaaaacaagtgttcgtgatacactgaatggacacgagaaatgaatgtaaggaagggtaacgtatgaataaacaactgaaagaaaaactggccctccttcccgatcagccgggctgttatttaatgaaagaccgtcaaaaaacagtcatctacgtggggaaagcgaaagtcttgaaaaacagggtgcgatcttatttcaccggttctcacgacgcaaaaacccaacggcttgtgtcggagattgaggactttgaatatatcgtgacttcctccaatcttgaagcgctaattttggaaatgaatctgattaaaaaatacgatccgaaatacaatgtcatgctgaaagatgataaaacctatccctttattaaaatcacccatgaacgccatccgcggctgattgtcacccggaatgtcaaaaaagacaaaggacgctatttcggcccgtatccgaatgtgcaggcggcgcgggaaacgaaaaaactgctggaccgcctttacccgctcaggaaatgctcaaagctaccggaccgcgtctgtctctattatcatctcggacaatgcctcgccccatgtgtaaaggatatatctgaggagacaaaccgcgagattgttgaagacatcacccgttttttaaagggagggcataacgaaatcaaaaaagagctcgaagcgaaaatggcagaagcggcggaaaagcttgaatttgaacgggctaaagaattccgcgaccagcttgctcacatcgaatcgacgatggagaagcaaaaaatgaccatgaatgaccttctggaccgcgatgtgtttgcatatgcctacgataaaggctggatgtgcgtccaagtctttttcatacgccaaggaaaactgatcgaacgcgacgtcagcatgtttccgatgtatcaggaagcggatgaagaatttctgaccttcatcggccagttctactctaaaaacaatcactttctgcctaaggaaattctggtgcctgacagcgttgacagggacatgatcaccgagctgttggaaaccgccgtgcatcagccgaaaaaaggcccgaaaaaagagctgcttttgcttgcgcacaaaaatgcgaaaatcgccctgcgggaaaaattctcgttaatcgagcgggatgaggaacggtcaatcggtgcagccgaacggctcggcgaagcgctgaatatttatacgccgcatcggattgaagcgtttgacaactccaatattcaaggcacaaaccccgtatcggccatgattgtctttattgacggaaaaccgaataaaaaggaataccgcaaatataaaattaaaaccgtaacagggccggatgattacggctcaatgagggaagtcatcagaagaaggtacacgagggtgctccgcgaaaatcttccgctgccggatttaatcatcattgacggcggaaaagggcagattaacgcggcgcgcgacgtgctcgagaatgagctcggccttgatgtcccggtagcgggattggcgaaagatgataaacaccgaacatccaaccttttgatcggcgacccgcttgaaccggtgtttctggagcggaacagccaagagttttacctgcttcagcgtattcaggacgaagttcaccgttttgcgatcagctttcacagacagatccggggaaaaagcgtctttcaatccgttctggatgatatccccggaatcggtgaaaaacgcaaaaaaatgctcttaaaacatttcggatctgtcaaaaagatgaaggaagcaagccttgacgatatcaaaaaagcgggtgtgccggccgcggcggcccagctgctgtttgaaaaattaaaaaaatagtattgtgcttttctgaaaaatctgctagaatgtgaactaatttcataagatcgtgttatatggtgaagatagaggtgcgaacttcattagtaagcctttggagaatgatggattctgcgaaaaaggctgaaaggggagcgtcgccgaagtgtatcacatcccatcggtgtgatttgctggccttgcattaaataaatgtaaggctgtcaagaattcattttcttggagggctatctcgttgttcataatcaatcgtaatgatatgaaaaagcaatgagagctattcctctcattgctttttttattgtggacaaaacgctcttttctcctcacccgcacgaaccaaaatgtaaagggtggtctagtatgggtcttatcgtacaaaaattcggaggcacttccgtcggctctgccgaaaaaattcaaaatgccgcaaatcgcgccattgctgaaaagcaaaaaggccatgacgtcgtagtcgtcgtttcggcaatgggaaaatcaaccgacgcgctcgttaacctcgcggctgaaatcacatctgaaccaagcagacgcgagatggatatgcttttgtctacgggagagcaggtcacgatttcgcttttggccatggcgcttcaggaaaaaggatatgacgccgtctcttatacgggctggcaggcgggtgtccgcacggaagccgttcacggcaatgcgagaattacggatattgatatcacggcgattcgttcgcagcttgcagaaggcaggattacagtcgttgccggttttcagggcgtaacggaagacggaggcatcacgacgctcggacggggcggttccgatacgacggcggtcgctcttgccgcagcgctggaagcggataaatgcgacatttatacagatgttccgggcgtatttacgacagatccgcggtatgtccggtcagcgagaaagctggcgggaatttcttatgatgaaatgctggagcttgcaaatctgggagcgggtgttcttcacccgcgggcggttgagttcgcgaaaaactaccaagtgcctttagaagtgcggtcaagtacggaacatgaagcgggaacattaattgaggaggaatcatcaatggagcagaatttaatcgtcagaggaattgcatttgaagaccagatcacgagggtgtccgttacgggcctgacaagcggactgactactctttcaacaatcttcaccgcgctggcaaaacgaaacatcaacgttgacattattattcagacacagtcggacgatggggaagcggatatttctttctcagtgaaaacggaagatgccgcgcaaacggtcgccgtgcttgaagaatataaaaacgcgcttgactatgaaaaaattgaaaccgaaagaaaactggcgaaagtctccattgtcgggtcgggcatggtttcaaatcccggcgtcgccgcggacatgtttgccgtactggcggaaaaaaatgtacaagtcaaaatggtgagcacatctgaaataaaagtatcagcggttgtcagcgaaaatgatatggtgaaagcggtcgaagcgcttcatgatgcgtttgagctttctaaacagccgtctgctgtgtaaacgggcaggcaaaaaggcgggacttggagtcaccgccttttttcaattatacagggtccttcatatcccattttacagtcaggacgactttatccgctctcttttttacctgttcataagattctgcgatctgatcgttcatcaattgaatctgttcggctataaaaccggcttcaagctgaaaacaaggctctttctgatgtttgagtctgctggatacgagcggtccttccagttcaaattccagttcttgtttttttgatcctgcgtttgtcaaagttccccagccggctttttcaaaaaaggcggggatttcttcccacgattgaagaggaaatttgcgggcgaggcgttttcccgcccaatacatcatcgatgaatactccgggccgaggatatccggaagcacgatttcccggattaattcgtagccgtatgcgctgacgtcgagttcagttaaaggttctaaagctgcttcataattattcttcatattatgtattcccctctctccttcgtttattatagcttaaacaggggggaggattacaggatgatcctataaaacacgcgaaaaaatgtgagaaagatatcgcaggaaaataaaattttccctccagataatcaattccgaaaattataatttatgtacacgttttcttgacgcccttttgagggaggagtaaaatgaaattgtcaataaattttaataaagtgcttacaattgaaacgaagtgggggcagagattttagtacatttcgcacttaaatcaaacagggggtaaagtaatgtctgggaacagagagttttattttcgaagattgcattccttgctcggtgttattccggtcggcatctttttgatccagcatttagtcgtcaaccaatttgccgcaaggggagcggatgcgtttaacaaggcggccggctttatggacagtctgccgttcaggtatgcgttagaaatttttattattttcttacctttaatttatcatgcggtttacggtgtgtacatagcatttactgcgaaaaacaacgctggccactacagttatttcagaaactggatgtttgtgcttcagcgtgtcactggtattctcacccttattttcgtcagctggcatgtatggcagacgcggattgccgcgcagatgggcgctgaagtcaacttcgatatgatggcgaatattttgagctcgccgtttatgctcggtttttacattgtaggcgttttatcggtcatttttcacttttcaaacggcttatggtcttttgcggtcacatgggggatcacggtcacgccgcgttctcaaagaatttcgacttacgtgacgctgattatatttttagcgctttcatacgtaggtttaaaagcgatttttgcgtttgtgtaagagaactagattactagagggagaggggctatcatgagtcaatcaagcattatcgtagtcggcgggggtcttgccggcctcatggcgacaattaaagcagcggaatcaggcacggccgttaaattgttttccatcgttccggtcaaacgctctcactcggtctgcgcgcagggcgggataaacggagctgtcaacacaaaaggggaaggagactctccgtttgagcattttgatgacacggtatacggaggcgactttttggcaaaccagcctcctgtaaaagcgatgtgtgaagcggcgccgtccattatccacttattggaccgcatgggggttatgtttaacagaacgccggaagggctcttggacttccgccgtttcggaggtacacagcatcacagaaccgcatacgcgggagcgacgacgggtcagcagcttctttacgcactggacgagcaggtgcgcagatatgaagtggcgggtctcgttacaaaatacgaaggctgggaattcctcggcgccgtgcttgacgatgagcgcacgtgccgcggtatcgtagcccaaaatctgaccaatatgcaaatcgagtcattccgttctgacgccgttatcatggcgacgggaggacccggaatcgtattcggaaaatcaacaaacagcatgatcaatacgggatctgccgcatcaatcgtctatcagcagggcgcttattatgcaaacggcgaatttatccaaattcacccgacagcaatcccgggggacgataaactgcgtctgatgagtgaatcggcgcgcggcgagggcggaagagtctggacgtataaagacggaaaaccttggtacttcctcgaggaaaaatatccggcttacggaaacctcgtgccgcgggatattgcgacacgtgaaatctttgacgtgtgcgtgaatcagaaactcggcatcaacggagaaaacatggtgtatcttgatctgtcgcacaaagatccgaaagagcttgacgttaagctgggcggcattatcgaaatctatgaaaaattcatgggcgatgacccgcgcaagcttccgatgaaaattttccctgccgttcactattcgatgggcggactgtgggttgattatgatcagatgacaagcatccgcggactgttcgcagcgggtgaatgtgattattcaatgcacggaggaaaccgtttaggggcgaactctctgctttccgccatctacggaggaatggtggccggaccgaatgcggtgaaatatgtttccggacttgaaacatcagcggaagacctgccttcttcattatttgattcctatgtgaaaaaagaagaagaaaaatgggccgatattatgaagatggacggcgacgaaaatgcctacgtgcttcaccgtgagctcggagaatggatgacggccaacgtcacggtggtccgccacaacgacaagcttttgaaaacggatgacaaaatccaagagctgatggaacgctttaagaaaatcaatatcaacgatacgacaaaatggagcaaccaaggggcgatgttcacccgccagttctccaatatgcttcagcttgccagagtcatcacgctcggcgcatataaccgaaatgaaagccggggagcgcactataaaccggatttccctgaaagaaatgacgatgagtggctcaaaacgacgatggctaaacatgccggtccgtttgaagctccggaatttgaatatcaggatgtcgatgtatcactgattgcgccccgtaaacgcgactactcgaagaagaaggtggcgaaataatcatgagtgagaaaaagatacggtttatcattacacgtcaggatacgcccgaaagcgcgccatacgatgaagaattcgaaatcaattaccgcccgaacctgaacgtgatttccgccctgatggaaatccgcagaaatcccgtgaatgcaaaaggagagaaaactactccggtcgcatgggacatgaactgtcttgaagaagtatgcggcgcctgctccatggtcatcaacgggagaccgcgccagtcatgtacggcgctgattgataagctggaacagccgatccgtctgaaaccgatgaaaacattcccggttgtccgtgaccttcaggttgaccgcagcagaatgtttgattcactgaaaaaagtgaaagcatgggtgccgattgacggaacttacgatttggggccggggccgagaatgccggaaaaacgccgccagtgggcatatgaattgtctaaatgcatgacatgcggcgtctgcctcgaagcctgcccgaacgtcaacagcaagtcgaaattcatggggcctgccccgatgtcgcaagttcgtctgtttaacgcccatccgacgggcgcgatgaacaaagcagaacgtttagaagcgttaatgacagacggcggcctcggagattgcgggaattcacaaaactgtgttcaatcctgcccgaaaggcattccgcttacgacttcaatcgccgctttgaacagagataccaatttacaagcattccgtaatttcttcggaagcgacagagtataagaaagagaaaaagagcctcttccgcacgggagaggtttttttataaggagctgaaggtgatgaaacaaccgcaatatattgatgtcccgtttgaagaatggagacagtcgttttctttctttactgaagtatcggttcgtttttcagaaacggatatgttcggccatatgaataatgtaacccctttcatctattttgaagaagcgcggatcgcttatttcaaacagcgaggcataacggcgcaaaactcggaaacgatgacggtcgtcgcaagccagcagtgcgactatatgcgtcaggtgatgccgtatgaaaatctgcggatttatgtgaaagcaagcgctgccggaaatgcgtccgtcacccttcattaccttggagaaaatgagtcgggcctgccgtgctttacaggttccgtcgttatggttcaagtgtcgaagaaaagcggcaaagcggtcagctggacggagcgggagaaaggcattctgctcgcctgaacggataactatttctctaagagacgtcacctccgaagcgccctttacatatgatatcttgactatataaacccattcgtttcagattcgctctcaccttagcaaggagggttacaatacttgaaggagaaagattttcaatcaaagccgctgctgaccaaaagagaaagagaagtattcgaattgctcgttcaagacaagacaacaaaggaaattgcaagcgagctatttatcagtgaaaaaactgtacggaatcacatttcaaatgccatgcagaagttaggtgtgaaagggcgttcgcaagctgttgtcgagcttcttagaatgggtgagctagagctctgattcttgccggttttccttcttttcgagaaggagccggttatttgcgttggcgcccgggctgatgggcatgcggtgaaaatcccggtttttcctttttctccgtcagtcttgcattttcttaaaaaaagaaggaaaatagacacggagcgcatagcccagaaagatccttgagtgagggatggacaaatgacatcaaaatctgtagagcatgttgcggatatcgaaaaatcactccgccatatcgctgcgatcattaaacaaaaaggaagagaaatccttaaccaatatgcaattacaccgccgcaattcgtggggcttcaatggctttatgaattgggggatatgacaataggcgaattatcaggcaaaatgtatttggcttgcagcacgacgacggatctgatagaccgcatggaaaaaaataagcttgtcgagcgggtgaaagacccggccgacagacgggtcgtcagaattcatcttctcgctgaaggagagcgcattatccaagaagtgattttgaaaagacaggcttatttgagggatatgtttgcgacattttccgaagaagaaacagccgctttcgaaaaatcattattgaaactgcagcatgaaatgaaaagaaaatgaggcgattttgttggaacagccgataggagtcattgattccggggttggcgggttaaccgttgctaaggaaatcatgagacagctaccgaaggaaaatatcatctatgtgggagatacaaaacgctgcccgtacggcccgcgtcctgaagaagaagttcttcaatacacgtgggaaatgaccgattacctgctggaaaaccaccatatcaaaatgctcgtaatcgcctgcaatacggccacggccattgccttggaggatattcagcgcaaaacggatattccggttgtcggcgtcattcagccgggtgcaagaacggcgataaaggtcacgaaaaaccagcatatcggcgtcatcggcacggtcaataccattaaaagcagagcgtatgagcaggcgctgctcggattaaacgcagaacttcaagttaagaacacggcttgtccgctgctcgtgccgtttgtggaaagcggacggtttcttcaggaatcagcggaggaagcggttgaagcatcgcttgagcctttaaaaggtacatcaattgacaccttgattttaggatgtacgcattatccgattttaaaagatccgattcagaactatatgggagagcatgtgaaaatcatttcctccggagacgagacggcgagagaagtgagcaccatcttgtcttataaaggtttgttaaaccaatcgaaacatgcaccggagcatcaatttcttacaacgggagagcggaacggtttcgcaaaaattgccgaagactggttcggccacgaaatcggccatgtcgagtgcatctcccttcaagagccggtcagaaaataaatcaaaaaaacccgctgtttacggcgggtttttttgcgcttcccggtctatttcccggacagggctcgtatacatcatagtacaaacagccttaggagggaaaagtatgctgaaaaaaggacctgcagtcattgctgcaacatgtcttacttcggcttttgtgttatctggatgcggtttgtttcaatccgataaaacagccggggaaattgacccgcctcaagacatttcatatgtaaaggatgaagcgggaattcaggcaaaaccaaagcagtcagagaaaaacggcacttctaaagccgaccagccggccaatacagtcatgcgagagctgtatctgattgataaaaacggctatgtcgcagcacagacactgcctcttccgaacagtgagggaaccgcaaagcaggcccttgagtatttggttcagggagggcctgtgtcagaaatcctgccgaacggcttcagagcggtgctccctgcggatacgacggtaaatgtcgatattaaaaaagacggcactgccgtcgctgatttttcgaaggaatttaaaaactataaaaaagaagacgaacaaaaaatcctgcaatcgattacatggacgcttacccaattcagctcaatagataaagtcaaaatcagaatcaacgggcacgaactgaaagaaatgcctgtgggcggcactccgattacgggcgacttaagcagaaaagacgggattaatattgaaacggccggagtgaatgatctgacagacacccatccgctgactgtctattatctggcggaaacagagacaagcgaatactacgtgcctgtcacaaagcggattgacaattcggaaacagatgacatcaccgctgccgttgaacagctcgccgacggaccgggcaaagcaagcgggcttttgacggactttaataacgatgttaagcttctcagcaagccgaaagtgaaagacggccaggttacactggactttaacagctccatttacggaagcgccgacgaaaaaacaaaaatggtatcatcgggcgtattggacagcatcgttctcacgttaaccgaacagccgtcgattaaaagtgtttctataaaagtaaacggaaaatcagaactggtgaatgaaaaaggagaatccctttcaaaacctgtttcgaggccgtcacaagtgaatacgggtagtttttaatttgcgatttttgatatactagtaaaaaagaggttagcgttccggctgcctctttctttattcacaatccggaacaaaaggtttatgtacatataatcggaggtaaaatatgagacacgacggaagacagcacgatgagctgcgccctatcacatttgatttggattttatcactcacccggaaggctctgttttaattacagcgggaaatacgaaggtcatctgtaatgcatctgtggaagaccgggtgccgccatttttacgcggcggaggaaaaggctggatcacagcggaatacagcatgcttccccgcgcgacgaatcaaagaacgataagagaatcttcaaaaggaaaggtctccggcagaacgatggaaattcagcggctgatcgggcgcgcgctccgggccgtcgttgatttggagaagcttggcgaacgcacgatctggatcgactgtgacgtcattcaagctgacggcggaacaagaacggcttccattaccggcgccttcttggcaatggccattgcgatcggcaaactcgtaaaaagcggcgttatcaaaacctctcctgtgacagattatctcgcggccatttctgtcgggatggataaagaagaaggccttcttttggatctgaattatgaagaggattcggcggctgaagtcgacatgaatatcatcatgacgggaagcggacgttttgtagagcttcaagggacgggcgaagaagccacattctcccgtgaagatttaaacggactgttaagtcttgccgaaaaaggaatccagacgcttattcaaaagcaaaaagaagtgctggcagaaacattgcctgaactgaaataagaaagagaggcctgatcagcgtgaaagaagccattattgcgacacacaatcagggaaaagtgaaagaattcaaggaaatactcgaaccgaaaggctacagcgtctcttctttggcggaaatcggatttacggaagaaattgaagaaaccggacatacctttgaagaaaacgccatcttaaaagcggaagccgtggcaaaagccgtcaacaaaatggtcattgcagacgactccggtttatcggtggacaaccttggaggcagaccgggcgtttattcagcccgttatgccggagaagcaaaagatgataaagcgaatatggacaaggtgctgtcagaattaaaaggcatcgaaaaagagcagcgcacggcccgtttccgctgcgcccttgccgtcagcatgccggggcgggaaacaaaaacggtcgaaggtcatgttgaagggtatattgcggaaggacccgagggggataacgggttcggctatgatcccatttttattgtaaaagataaagataaaaccatggcccagctgacaagcgctgagaaaaacaaaatcagccacagggctgaggcgctcaagaaactgtcaaagctgcttgattcataagggggagcgtatgcaatgaaagtgctgataataagtgacagtcacggccttgaagacgagctggagacgattgcaaagcggcacgaagacgaagcggatctgatgattcattgcggtgattcagagcttgacgccgcacatccggcgcttacgccgtttcacacggtaaaaggcaattgcgactttggcggcgggtttcaggatgaacttcttctggacgcaggttcaaagaaaattctggccgttcacgggcatcttcacggcattaaacagtcacttttaactgttttttaccgggcggaagagcttggggcggatatcgtctgcttcggccattcacatattgccgggagtgaagagcttcggggcaagcttttgattaatccgggcagcatccgtcttccgagagtccgcaatgtgaaaagctatgccattcttactcttacagaaagagaaggcgccgtgacattttacgatgaaacgggtcgggaattgaaggactttgggaatacaatcagtttttaacaagtgatgggggagatttcattcttccccatcaaaagtttttaaaaaaatattgacttatgatttgaacctgtatataataaatcttgtcgctgatacataaagcaaaagctgtcccagtagctcagctggatagagcaacggccttctaagccgtcggtcgggagttcgaatctctcctgggacgtataaaaaaagagctggtgacatcagagtgaaaactgatgccgctggccttttttatcggatgactatattgtcaattcgctgatatcatggtaaaatgatcagcagaacaatttgattttcatgtcccagtagctcagccggatagagcaacggccttctaagccgtcggtcgggagttcgaatctctcctgggacgtataaaaacctcaagccctgacaatgggtttgaggtttttttgtattttattttttgttttacgaaacaaaagttccgtatttgatgaaaattgtaaagtaattttaatataaatgaaacttaatgtaatatttatcgtaataaatatatgtataaagatacttaaggcgcccttgagtgataaattatctaatttctatcatacattttgtcaatgaatgatagaaagacagcaggaggaattagcttttgaagtacgcatttgcatataaaaatcacaatatagaaacgatcttttgcggaaaagacgagctgtttgaggaactgaagcaatttttaatcactcaatgcggtttaatcattgttgaggtttcaagggctgattactatacggagcaggaaatgaatcaatggaatgaccgttatactctgtgaataagaaaagaaaccggccgtgggaggccggtttttgtatcatctgaatccgctcggagcgctgaagcccccggcatggccgctgaaaccgcccccgagcgcgccgggatgcgccccggcgccgaggcttccgccgacgtcactgaaggattggccgtagtacccggttgtataagggtacggaacgaattgctgcccggcgaatgacagcgtgctttgcggggtctgctgtccgtatccggatgacgggaatccctgctgaaaagaagggccgccttgatttggtgctgtatgcatcggggccggaggatagtaagactgcggcggtaagaccggtaaaggcggaaatccaggaggcaggccctgcatgcctgataacatcttattcatgacatcactcatttcttacgagataagaacagtgtatgcgtatgtctgtagaaagagcctgttcaatcgaacggaatatctgacaagcatgccggaaggacagagaaaaattgtgtaataaaatgtgacatattcgtatatgaacggaaaaatttcatgtaatcttgagagattaataaaaaaatgataaaaacttttaacatttacagatccctttgtaccagtaatgaaagcgtatacaaaatagattgattaatctaaattgtctaataattataaaaatgctgttgacactgtctgcaaacgggcgtaatatgagttcaaacaaaaacaaataaatgattcacgctaaaaagaaaaatcataaaacactgaaaaaacaaacaaatgaaggttcttttttaataaaagagctgccataataaaaagcgcagaagaggataagtagctttgctgaagtttttcacagagagccggtaacgctgagagccggtaaaacaaatcaaagtgaactcccctcagagtgccggtctgaaatatgaagagtaggactcggccgagtgaacgcaatgtttactcgttatcaaaacggatattcattatccatgagacggtctgcatatgaccgtaaacaagggtggtaccgcggaaagcaaagccttttcgccccttttggctatcgcatgaaatgcttggctgaatgtgggtgggaaggcttttttatttgcgtcagccggcgctgcgttttatgaattggattttagaagggaacattgaaaaggaggaactgaaaatgggtacaaatgtacaggcggattctttgtctgccgaatgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacttccggacccggagcgacaaatttagttaccggtcttgcggatgcgatgatagattcattgccgctcgtagtgtttaccggtcaggtggccacttcggtcatcggcagcgacgctttccaggaagccgacattttaggaattacgatgccgattacgaaacacagctaccaagtccgccgtccggaagatctcccccgtgtgattaaagaggcgttccatatcgccacgacgggaagaccgggcccggtattaattgatataccgaaggatgtcgcagcatttgaaggagagttcagatatgatcacgagatcagccttccgggttatcagcctgtaaaagagcctaactatctgcagatccgaaagctcgtggaagctgtcagcagtgcgaaaaagccggttattttagccggagcgggtgttttgcacggtaaagcttcagaagatttaaaaaattatgccgaacagcagcaaatcccggtagcgcacacgcttctcggtctgggcggtttcccggcagaccatcctctttttctgggaatggcggggatgcacggcacatacacagcgaatatggcgctttaccactgtgatttgttgatcagcatcggagcgcggttcgatgatcgcgtgaccggaaatctgaagcattttgcaaaatcggccaaagtggcgcatatcgatattgatcctgctgaaatcggaaaaattatcgaaacgcagattccggtggtcggcgacagtaaaatcgtccttcaggaattattgaagcaaaacggaaaacagggacagacagaggagtggaaacagcagctttcagaatggaaagaagaatatccgctttggtatacagacaacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggttacctcggggggactcggcacaatgggcttcggccttccggcggctatcggagcgcagctggccgatcgtaacgccacggtcgttgccatcctcggagacggcggttttcagatgacccttcaggaattagatgtcatccggcagctgaatcttcctgtcaaagtggttatcttgaacaacgaatgtctgggcatggtcagacagtggcaggaaatcttctatgaagagcgctattctgaatccaaattctcggcgcagcctgactttgtcaaattgtcagaagcctacggcattaaaggcgtccggatttcatcggaggaagaggcggaagaagagcttaaaaaggcgctttcatcaaaagaaccggccgttattgacgtccgggtcgccaaaagcgagaaagtattcccgatgattgcgccgggtaaaggacttcatgaaatggtgggggtgaaaccttgaaacgcattatcacattaacggtggtcaaccgctcgggagtattaaaccggatcaccggcctgtttacaaaaagacactataatatcgaaagcatcactgtaggccacacggaaacaagcggtgtttcaaggattacatttgtcgtccatgtggaaggcgaaaatgacgtagagcagctgacaaagcagcttaacaaacaaattgacgtcctgaaagtgacggatattacaaaccaatcgattgtacagcgtgagctggcattaatcaaagttgtttccgcaccgtcggccagaacggaaatcaatggaatcattgagccgttcagagcttccgtcgttgatgtctcaagagacagcgtcgtcgttcaggttaccggcgaatctaataaaatcgaagcgctcatagagctgctcaaaccctacggcattaaagaaatcgcgagaacgggcacaacggcttttgcgaggggaacccagcagaaggcgtcatccaataaaacaatttcaattgtataacacaaaaaagggagagattaaaatggtaaaagtatattataacggtgatatcaaagagaacgtattggcaggtaaaaaagtagcgattatcggttacggttcacaaggtcacgcacatgcgctgaacttaaaagaaagcggaattgatgtcattgtcggcgtcagacaaggaaaatcatttacacaggcccaagaagacggtcatcaagtcttttcggtaagagaagcggctgcccaggctgatatcattatggttcttcttccggatgaacagcagcaaaaagtatatgaagctgaaatcaaagatgaattgacggcgggcaagtcattggtattcgcacacggatttaacgtccatttccatcagatcgtgcctcctgctgatgtggatgtattccttgtcgcccctaaaggaccgggacaccttgtcagaagaacatatgaacaaggcgcgggcgtaccggcattgtttgccatctaccaggatgtatcaggcgaagcgaaagatacggctcttgcttatgcaaaaggaatcggcggagcgcgtgcgggcgttcttgaaacaacatttaaggaagaaacggaaacggatttgttcggtgagcaggctgttctgtgcggaggtttaacggcgcttgtcaaagcgggttttgaaacgctgacagaagccggctaccagcctgaactcgcatacttcgagtgtctgcacgaactgaagttgatcgtagacttgatgtatgaagaaggattggcgggcatgagatactctatctccgatacggctcaatggggagattttgtctcagggccgcgcgtagtcgatgcaaaggtaaaagaatcgatgaaacaagtattaacagatattcaaaacggtacattcgcgaaagaatggatcgtggaaaaccaagtgaaccgtcctcgcttcaatgcgatcaatgcaagtgaaaacgagcatcagattgaaaaggtcggcagacagctccgtgaaatgatgccgtttgtcaaacaaggcaaaaagaaggaagcggtggtctccgttgcgcaaaattaatgttttcgacacgacccttcgtgacggtgaacaatcccccggggtcaacctcaattcccgggagaaactggcgatagccaagcagcttgaaagactcggggtggacattattgaagcgggatttcccgcttcatcccgaggtgattttttagccgtgcaggaaatcgcaagaacgattaaaaattgttcggtaacagggcttgcccgatctgtcaaaggtgacatcgacgcagcctgggaagcgctgaaagacggggccagcccgcggattcacatctttatcgccacctctgacattcatctgaagcataagctgaaaatgacgcgggaagaggttaaggaaaaagcggttgaaatggtgaagtatgcaaaagaacgctttccgatcgttcaatggtcagcagaagacgcatgccgcaccgaacttccgtttctggctgaaatcgttgaagaagtgattgatgccggcgcgagcgtcatcaacctgccggacactgtaggttacctgacgccggctgaatacggaaacatctttaaatatatgaaggaacacgttccgaatatcagccgggtaaagctatcagcccattgccacgatgatctcggaatggcggttgccaactcactttcggcaattgagaacggcgctgatcaaattgaatgcgccattaacggcataggagaaagagccgggaacgccgcgctagaggaaatcgccgttgcgcttcatgtcagaaatgacgcgcatcaagccgattcatctctcaatcttcatgaattgaagcggacgagtgatcttgtcagcaaactgacgggtatggcagttccccgcaacaaagcaatcgtcggagataacgctttcgcacatgagtccggcattcaccaagacggtttcctgaaagaaaaatcaacatatgaaatcatttcaccggaacttgtcggcgtgactgctgatgcacttgtactcggaaagcattccgggcgccacgcgttcaaagaccgcctgaatacgcttggattccagtttgatagtgatgaaatcaataaatattttacgatgtttaaagaactgaccgcaaagaaaaaagaaatcactgatgatgacttgatttctcttattttagaagaaaaagtgacagacaaaaaaatcggctatgaatttttgtctctgcaagtgcattacgggacgtctcaggtgccgactgcaacagtctctttaaaaaatcaggaaaacgaacagctgatgcaagaggcggcaacgggggcgggcagcgtagaagccgtttataatacgctcgggcgctgcatcgataaaaatattgaactgacagactaccgcatccaatccaaccggaaaggcgaagacgcgctggctcaagtttttgtcagagtgaccgtgaacggaaaagaaacatcagggcggggaatcgcgcaggatgttctggaagcttctgctaaagcttatctgaacgccgtgaaccggcagctggtgctggattgcaatttagacggattaaagagacagactgcggtcggctcgtaatagaaaggagaacgtttgatttgaaaaaacgcattgctttgctgcccggtgacggaatcggaccggaagtggcggaatcagcggcagatgtattgaaaagcgttgccgaacaattcggacatgaatttgaatttgaaaacggactgatcgggggagcggccattgacgcccatcaaaacccccttcctgaggagacggtggctctttgtgaaagatccgacgccatcctgctcggggcagtcggcgggccgaaatgggaccaaaatcctccggagctcagaccggaaaaaggcctgctcggcatcagaaaaaaactcggcctgtttgccaatttgcgtcccgtgaccgtatttgaaagcttgtctgaggcatctccgctgaaaaaagaatatatcagcggcgtcgactttgtaatcgtcagggaactgacgggcggcctctacttcggagaaccgagcagacagtatgtcaatgaagcgggagaaaaggaagcggtcgatacccttttttataagaaagaagaaatcgcacgcgttgtcagagaagcctttaagatggctgccggcagaaaaggaaaagtgacgtccgttgataaggcgaatgtgctttcttcaagcaggctgtggcgggaaaccgcagaggaaatcgcaaaagaatttcctgatgtgacgcttgaacatatgcttgtcgataatgccgcgatgcagctcatctacgctccgagccaatttgacgtcatcgtaactgagaatatgttcggcgatattttaagcgatgaagcctccatgctgacaggctcgctcggcatgctgccgtcagccagtttatcaagttcaggtcttcacttgtttgaacccgtgcatggatctgcgcctgacatcgccggtaaagggatggccaatccgtttgcggcgattttatcagctgcgatgcttttgagaacatctttcggacttgaaaacgaagcgcaggcggtggaaaaggcggtcgcaaaggtgcttgcagacggcagccgtacacgtgatatcgcccgggacggccaatatgccggaacgcatgacattactgaaaaagtaaaagccgcattagccggctcgaatacaaaatctatagtgtgacgctttaaagaaagcggtcttagttcataggtagagggaggaaacaaagatgatgcctcgaacaatcatcgaaaagatttgggatcggcatgttgtaaaaagcggtgaaggaaaacccgaccttctctatattgacctgcacctcattcatgaggtgacgtctcctcaggcgtttgaagggttaagacagaaggggagaaaggtcagacggccgcagaatacattcgcgacgatggaccacaatattccgaccgtcaaccgttttgacattaaagatgaagtcgcaaagcgccaagtaaccgcgcttgaacggaattgtgaggagtttggcgtccgtcttgcggatcttcacagcgcagaccaggggatcgttcacgtagtcgggcctgagcttggtctgacacttccggggaaaacgatcgtttgcggagacagccatacatcgactcacggtgcattcggggcgcttgccttcggtatcggcacaagtgaggtggaacatgttctttccactcagacactatggcagcagcggccgaaaacgcttgaaatccgcgttgacggaacgctccaaaaaggagtgaccgcgaaggatgtcatcttgtcggtcatcggaaaatacggggtgaaattcggtaccggatatgtcattgaatacaccggggaagtattcagaaacatgtctatggacgaacgcatgacggtctgcaatatgtcaatagaagcgggagcacgggcgggactgatcgctcctgatgacacgacgattgaatattgtaaaaaccgtaaatacgcgccaaaaggcgaggaatttgaaaaagccgccgcagaatggaaagcgttaaaaaccgatccgggcgccgtatacgatcattccatcgtgttagacggcagcgagatttctccaatggtaacatggggcgtcaatcccggtatggttcttccggtcgatgcccaaataccggcgccggaaacgattgattctgaagacggtaaaaaagaagccatccgcgcgtacgaatacatgggaatctcaccgaatcaaaaaattgaagatattaaagtcgagcatgtgtttatcggctcctgtacaaattcgcggatgaccgatcttcgccaggctgcggatatgatcaaaggccgaaaagtcgctgacagcgtcagagccattgtggtcccgggttctcaaagcgtgaaacagcaggccgaggaagaagggctgcaccgcgtgtttctcgaggccggatttgaatggagagaatcaggctgcagcatgtgcctcagtatgaacaatgatgtcgtgcctgaaggggaacgatgcgcttccacttccaaccgcaacttcgaaggcagacagggaaaaggcgcgagaacacaccttgtcagtccggcgatggcggcaatggcagccattcacgggcatttcgtcgatgtaagaaagttttatcaagaaaaaacagttgtgtaaggagtgcgcgaaaagatggaacctttaaaaacacatacgggaaaagcggccgtcttaaaccggatcaacgtcgatacggaccagattattccgaaacagtttttgaaaagaattgaaagaaccggatacggcagattcgcgttttttgattggagataccttgagaacggtgagcctgatcctgaatttgaattaaatcgcaaagtctatgaaggcgcgtccatattaattgccggagagaatttcggctgcggatcatcccgtgagcacgctccttgggcgctggatgattacggcttcaaaatcatcattgctccgtcatttgccgatatttttcatcaaaactgttttaaaaacggtatgcttcccatccgtatgccgtatgatcagtggaaaaaactcgccggtcaatatgaaaatcagtctcttaacatgacggttgacttggaaaaccagctcattcacgacagtgaaggaaaagagatttcatttgaagtcgatcctcactggaaggaaatgctgataaacggctatgatgaaatttcattaacgcttctgctggaagacgacatacagcagtttgaatcgaaaagaagttcatggcttcaagcctgaaaaaagccgaccggcatctgtccggcggctttttttaccgtgcgcaccatcctttcttgtgtttcctgacgcgtgttgatacacttgaaaaaaatagcgcctgaaaggaaataaagtatgacgcatgacaagaaaaaagctgatatcattcctttcccccgtctgaaagaacgcttggttgataaagggatggccgccatgaaggataaacagtatcaggaggccctcgaactgttctcagaggcggtaagccacggcgataccgagtccgacgtacatttaggcatggcgatttgttttctggaactcggggaattggaagaagcaaaacaagtttgcgagaaaatgctgaatgaagggtacggccattatttcaccgtactgcaggtgtacatgaccattttaattcagctgaaacaatatgaagaagtcaaaagcacaattgaagctgtgctggaagaaaaccagctgcccgcagaaagtgcggagcaattctaccggctgctcgaattcagccgcaaaatgaccgatcccgatcagcaggatgaggcgtgggaggaggaatacgaggacattcttgatgcggaaaaagtgctgaacagccccgctgaacaaatgaatctgattcattctctcaaagaccgcaatattgcaaaatacacgggtctcttaaaaacaattcttcaagatccgggcgctcatcctcttatcaagacgatgattttgacgctgatggcggaccatgactacagcaagccggtccatattacaaaattcggcgattcaatgaccgcggttccgagtgaaacggttcagcctgatgcggctccgattttgcatcgcgttctccgggtgcttgatgaaacgctcggcaatgaaaaccctacattatacgctgccgtcgaggagctgtggagaaggcatctgtacgtcctgcacccttttatgccgaagtttttgaacgcagatttatgggcggcggcgcttcataaggtcggttacgagatgcacggcattgacattgagccggaggaacttcatatgatgtacgagtttgacagccgcgaacttgaagaagcctgcacgatgattaaggatattgaagaaatttcttatttgtaaatcacaccatatagttgaaagcggtaggcgttatgttataatatagtggttgtatttatgtatagcggtttaactgaaatgagaattacggttggacaggctgccagttcattacataatgattctgattcaaagcggttttttctttgacaaagccgcggattgctttagaatggaagaccgacacaacctgaatagatttttggagggaaacacatgtctgtaaaatgggaaaaacaagaaggcaacgaaggcgtattaacggttgaagttgatgccgatacgttcaaaacagctcttgatgatgcatttaaaaaagtagtaaaacaggtttctattcctggattccgcaaagggaaagttccccgcggtttattcgaacagcgtttcggcgttgaagctctttaccaggatgctttagatattttacttcctgtagaataccctaaagcggttgaagaagccggcattgagcctgtagaccgccctgaaatcgatgttgaaaaaatcgaaaaaggcgaaagcttgattttcactgcaaaagtgactgtaaaaccggaagtgaaacttggcgactacaaaggcttaggaatcgaaaaagatgacactgccgttactgacgaagatgtacaaaacgaacttaaagcgcttcaagagcgtcaggctgagcttgtcgtgaaagaagaaggcgctgttgaaaacggcgatacagtcgttcttgacttcgaaggtttcgttgacggcgaagcgtttgaaggcggaaaagctgagaactactcacttgaagtaggatcaggttcattcatcccgggcttcgaagagcagttaacaggccttgaagcaggcgctgaaaaggatgttgaagtaacattccctgaagagtaccacgctgaagagcttgccggaaaaccagctgttttcaaagtgaaaattcatgaaatcaaagcgaaagagcttcctgagcttaacgacgaattcgcaaaagacattgacgaagaagttgaaacgcttgctgaattaactgagaaaacaaaaaaacgccttgaagaagcaaaagaaaacgaagctgacgctaaattgcgtgaagagcttgttctgaaagcgtctgaaaacgctgaagctgatgttcctcaagcgatgatcgacactgagcttgaccgcatgctgaaagaattcgaacagcgtctgcaaatgcaaggcatgaaccttgagctttacactcaattctcaggccaagacgaaaacgcgttaaaagagcaaatgaaagaagatgccgcaaaacgcgtaaaatcaaacctgactcttgaagcgatcgctcaagcggaaaaccttgaagtaacggacgaagaagttgaagctgagctgactaaaatggctgaagcttacaacatgccggttgaaaacatcaagcaggcaatcggttcaactgacgcgatgaaagaagatttaaaagttcgaaaagcaattgattttcttgtagaaaaccgttaatatggttcataataatagacataataaaacagggcgcgattaattcgtgccttgttttgtacaattatgatataactctttttcttggggcaagatagtcattgccgggctgtttttcgtcatacatatagaatgtgcaagtgcgaaacacattgttaccgtcttactggaaagtatggtaaaatgcaatacatactcgatcgtagcaagaaccgttttcttttgcccttcaggtaaaagaaaaagtgagacaagattaaggggtgaaagaatgtttaaattcaacgaggaaaaaggacaattgaaatgctcgttctgcggaaaaacgcaagatcaggttcgtaagctggttgcaggaccgggtgtatatatatgcgacgaatgtattgagctctgtacagaaatcgtagaggaagagcttggtacagaagaagaagtcgaatttaaagacgttccgaagccgcaggaaatccgtgagattctgaatgaatatgtcatcggacaggatcaggcgaagaaatcacttgcggttgcggtatacaaccattacaaacgcatcaactccaacagtaaagtggatgatgtcgagctttctaaaagtaatatttctttaatcggaccgactggaagcgggaaaacacttcttgcccagacgcttgcgcgtattctgaacgtgccgtttgcgatcgcggacgctacatctctgactgaagccggatatgtcggtgaggacgtagaaaacatcctcctcaagctgattcaggcagcagattatgatgtggaaaaagcagaaaaaggcattatttatatcgatgaaatcgataaagtagcgcgaaaatctgaaaacccgtccattacacgcgacgtatcaggcgaaggcgttcagcaggcgctgctgaaaattcttgaaggaacggttgcaagcgtgccgcctcaaggaggacgcaaacatcctcatcaggaattcatccagatcgatacgacgaacatcctgttcatttgcggcggtgcatttgacggcatcgaacaaatcatcaaacgccgtctcggacaaaaagtcatcggcttcggctctgataataaagcggcagatctggaaaaagaagaactgctttctaaagttcttccggaagacttgctccgtttcggtctgattcctgaattcatcggccgtcttcctgtcattgcaagccttgagcagcttgacgaaacggcactggttgaaattctgactaaaccgaaaaacgcactcgtcaaacaatacaagaaaatgttagaacttgatgatgtcgagcttgaatttgaagacgaggcattatctgaaattgcgaaaaaagcgatcgagcgtaaaacaggcgcacgcggcctgcgttctatcattgaaggcatcatgcttgacgtcatgtttgatctgccgtcccgcgatgatattgaaaaatgtgtcattaccggagcgacagtcgcagacggtgaagcaccgcgtcttgtattaaaagacggcacagttgtcggccaagataaaacatcagcataacatgacaaaacctcctgactcgaattgatcaggaggtttttttcttgtcctgacccttctgaaaatgtttattccgggctttgctgggagatactagcggacagaggaatgaattggatacataaatcgttttttcaggagggaccagcatgagttggacagggatcgcattatttgtacagctgtttttcgggatagtcatcggattatatttttggaatctgctcaaaaaccagcgtacacaaaaagtgacgatagataaagaatcaaaaaaagaaatggaacagctgcgcaaaatgcgcgccatcagtttatcagaacctttatcagaaaaggtgcggccgaaaagctttcaggacattgtcggccaggaagacggaattaaagcgttaaaagcagcgctttgcggaccgaacccgcagcacgtcattatttacggtcctccgggagtcggtaaaacggctgcggcgcggctggtattggaagaagcgaaaaaacataaacagtcaccgtttcaaaagcaggctgtttttgttgaacttgatgcgacgaccgcgcggtttgatgaacgggggattgccgatccgcttatcggttcagtgcatgatccgatttatcagggagcgggagcgatgggccaggcaggcattccgcagccgaaacagggggctgtgacccatgctcacggcggggtattgtttattgatgaaatcggcgagcttcatccgattcagatgaataaaatgctgaaggtgcttgaagatcgaaaagtatttttagacagtgcgtattacagtgaagaaaatacgcaaataccgaatcacattcatgatatttttcaaaatgggcttccggcagatttccgtttgatcggagcgacaacgagaatgccgaatgaaattccgccggccatccgttcgcgctgtcttgaagtatttttccgcgagctggaaaaggatgaacttaaaatcgttgcgaaaaaagcagccgacaaaattcagaaagagatttctgacgaagctctcagtgtgctgaccacatatacgagaaacggacgtgaagccgtcaatatgatccagatcgccgccggcatggcggtgactgaggacagaaaagaaattacgacagaagatatagaatgggttgttcattccagtcagcttacacctaaaaatgagcagaaaatcgccgatgaaccgcaagtcggcatcgtgaacggacttgccgtctacgggccgaacagcggcgcattgctggaaatcgaagtgaatgtcacacctgcgcaggacaaaggaagcctgaatatcacgggaattgcagaggaagaaagcatcggcagccaatcgaagtcgatccgccgcaaaagcatggcaaagggatctgtggaaaatgttctgacggttctgcgcacaatgggcatcaaaccttcagactatgacattcacgtcaattttccgggcggaggcccgattgacggaccttcagcaggtatcgcgatggccgcggggattttttccgcgattcaccgcatcccgatcgaccatacggtggcgatgacgggagaaatcagcctgacggggcttgtcaaaccgatcggcggcgtcattccgaaaattaaagccgcaaaacaggccggagcaaaaacggtcattatcccatatgaaaatcagcagtccattctgaaacgaatagacggaatcaccattaaagcggtaaaaacgttccaggaagtgctggacgtcatattggttgaccctccttcagaacaaaaaccgtttgatatccaaatgaataaagaatccgtataaaccccatttttataatggggtttttttatggaggacatcttttcctttttcagaacagaaagaaagggtatactacgaagagactgttttatatacagggcaggcggataagccgattttgcccgatcccggaattgtacaacgatgaaaaagttgtattataatggttcatactaaagtcacggaggtgtcagtcacatggcagaagatacaaaacgcagcatcccgctcctccctttaagaggcttattggtatacccgacaatggttttacatttagatgtaggccgtgacaagtcggttcaggctcttgaacaggcaatgatgcatgatcatatgatttttttagccactcagcaggatatttcgatagacgaaccgggtgaagaggatattttcgccgtcggcacttatacaaaaattaaacagatgctgaagctgcccaacggtacgatcagagtgcttgtagaaggaattcagcgggcgcagatccttgaatacaccgaactcgaagattatacttcggtcgatatacagctgatgcatgaggatgattcaaaagacgtggaagacgaagcgcttatgcggacgctgctggaccattttgaccagtacataaaaatttctaaaaaaatctccgcagaaacgtatgcggctgtgactgatattgaagagcccggcagaatggcggatatcgtcgcttctcatctcccgctgaaattaaaggacaagcaggacattttagaaacggcggatattaaagaacgtctgaataaggtcatccgttccattcataatgaaaaagaagtgctggagattgagaaaaaaatcggtcagcgcgtcaaacgttcgatggaacgcactcaaaaggaatactacttgcgtgaacagatgaaagccattcagaaggagcttggcgacaaagaaggaaaaaccggcgaagttcagtcgctcacggaaaagatagaagaagcaggcatgcctgagcgtgtcaaagaaacggcgcttaaggaattaagccgttacgaaaaagtgccgtcaagctcagcggaaagctctgttatccgcaactatattgactggctcatcgcccttccgtggtcggatgaaacagaagataaacttgatattaaaaaagccggggaaatcttagataaagagcaccacggcttagagaaagtgaaagagcggattttggagtatttggccgtgaaacagctgacgaaaacgctgaaagggccgattctttgtctggccggacctccgggagtcggtaaaacatctcttgcaaaatcaatcagtacgagcatggggcgccgttttgtgagaatttcactgggcggagtgcgcgatgagtctgaaatccgcgggcaccggcgtacatacgtcggagcgatgccgggccgtattatacaggggatgaaaaaagccggtaaacaaaatccggtctttctcctggatgagatcgacaaaatgtcgtctgatttcagaggcgatccgtcttcggcgatgcttgaggtgctggatccggaacaaaacagcacattcagcgaccactatattgaagagacgttcgatttatcgaaagtgctgtttatcgcgactgcgaataaccttgcttccataccgggacctctcagagacagaatggagattatcagcctgtcaggctacactgaaaacgaaaagctggagatcgtgaaggaccacctgcttccgaaacaaatcaaagagcacgggctcacaaagagcaacctgcagattcgggaccaggcgattacggacatcatccgctactacacgagggaagccggcgtgagaacgcttgaacgccagattgccgccatttgccgaaaggctgcaaaagccattgtgtctgaggagagaaaacgcattaccgttacagagaaaaatctggccgactatctcggaaaacggatattcagatacggacaggcggaaaccgaagatcaaatcggggttgtcacggggcttgcgtatacgacggtcggcggagatacgctgtcaatcgaagtgtcattgtcaccgggaaaaggaaagctgattctgaccgggaagcttggagatgtcatgcgggaatcagcgcaggccgctttcagttatgtccgctcgaaagcggaacagttcggaatcgatccgaaattccatgagaagtatgacattcatatccatgtccctgaaggagcggtgccgaaagacggcccttctgccggaattacgatggccacggcgctcgtttcagcattaacggaccgtgcggtaaaacgcgaagtcggtatgacgggagaaattacgctgcggggccgcgtgcttccgatcggcggactgaaagaaaaggcgctcggcgcgcacagagcgggcctgaccactattattgcgcctaaagataacgaaaaagatatagaggatattccagaaagcgtcagagaaggactgaagtttatattcgtttctcacctggatgacgttttggaacatgccttagtaggagagaagaaatgaaagtcacaaagtcagaaatcgtgatcagcgcggtcaaacccgaacagtaccctgatggggggcttccggaaatcgcgctggcgggaagatcaaatgtaggaaagtcatcttttatcaattcattaatcaatcggaaaaacttggccagaacgtcatcaaaaccggggaaaacacagaccttaaacttttacatcatcaatgatgaattgcattttgtcgacgttcccgggtacggatttgcgaaagtttccaaaagcgagcgggaagcatgggggagaatgattgaaacctatatgacgacccgcgaagagctgaaagcctgcgtgcagattgtcgacctcaggcacgcgccgtctgctgaagacgtgaacatgtatgaattcctgaagtattacggcattcccgtcatcgttatcgcgacaaaagcggataagattccaaaaggaaaatgggacaagcacttaaaggttgtcaaacagacgcttgatatggatcctgaagacgagctgattttattttcctctgaaacgaaaaaaggcaaagatgaagcatggggagccattaaaaaaatgatcagccggtaataaaaaacccaaaacgcagtgcgttttgggttttatcgtatagttttgttccgcttgataaacaataataaaaggctgattccgatgaaaacatacggccagtatgttttgaagtgttccgtcggaatatggacggactccagccacgccgtaatttgtttaaagaagtataaaaagagggaaaaaccaatcatggcaaccgcttcgtatacatattcttttctggctgccgcaaataaggagaatccgaagacgaagagaatcatttcaaaatctcccggccaccatgagagctcaggtttggcgaaaaagtgtaaacctatgccgaaaagaagcatgccgatcaggacgtgaggcccggccgcttcctttttgccctgatacaagagcgcagcgcccaaaagcataaggagcaccggccattccccctgattcgcaaacaggtgaacctgtccgctctgaagccatgcgaataatgaagcggcaagcagaagtcccggtaataaaattgatgtttttttcatcctgtcacctacccgcagtaaaggatttttagtatgatgattacagtggaaacgagctttttatactatagcataacatttttgaaatctgttcacattttcccgaagaaactatgttataattattataaataataaattctatgttagaatgattataaataaattgcgatgtacgggggtgcatgaaagcgatgcatattcttgttgtgggagtagattataaatccgcccctattgaaatacgcgaaaaaataagttttcagccggatgagcttgcagaagcgatgcttcgtttaaaagaagaaaaaagcgttcttgaaaacattatcgtgtcaacctgcaaccgcaccgaaatatatgcggtggtcgaccagcttcataccggccgttattatataaaaacatttttatccgaatggttctcgctgccgaaagaagagctgtctccgtttctgaaattttatgagagcgacgcggcgatcgagcatttattccgtgtggcgtgcggcttggattccatggtcatcggagaaacgcaaatactcggccaggtccgctcgagctttaaaacggcgcaggcagaaaagacgatcggcaccattttcaatgagctgtttaaacaggcggtgaccgtcggcaaacgcacgcatgccgaaaccgatatcggcgccaatgccgtttccgtcagttacgccgccgttgaactcgcgaaaaaaatcttcggctcattgtcaaataagcacattttgattctcggtgcgggaaaaatgggcgagctcgccgcagaaaacctgcacggtcagggcatcggcaaagtaacggtcatcaacagaacgtttttgaaggcaaaagcgcttgctgaccgtttctccggagaagcgcgcagcttaaaccagcttgaacatgcacttgctgaagctgatattttaatcagttcgacaggcgcaagtgatttcgtcgtgtctaaagaaatgatggagagagcgggcagacagcggaaaggccgtccgttatttatggtggatatcgctgtgccgcgagacctcgatccggcgctgaacgatcttgaaggtgtttttctgtacgatattgatgaccttgaaggaatcgttgaagccaacttacaagaacgccgtgaaactgctgaaaaagtcgagctgttcattgaagcggcaattgttgagtttaagcagtggcttaatacgctcggcgttgtgccggtcatttcggcgctgcgtgaaaaggcgctgtccatccagtccgatacgatgcagagcattgagcgcaagctgcctcatctgacggtaagagagaaaaaacttctcagcaaacatacgaaaagcatcattaaccaaatgctgcgcgacccgattctgaaagcgaaagagcttgcggctgaagcggattcagatgaaaagctgaagctgtttatgcagatattcgatattgaggaagaggccggccgtcagctggacaaaagcctggataaccgccagacggttcattcgtttcaaaaggcagaagcaaaaacgggcttacgtccgcttgtaagtgagtgagggctgtatgattgatacagcaatggcaagacttaatgaagcgacaattgttatttatgcagtaagcgtccttttttactttatagattttcttcaacacaaccggaaggctgggaaaatggccttctggttgctttctattgtctggactctgcaaaccgtctatctttcttatttcatgtggcagacgggcagatttccggtcttgaatattacggaggccctttacttttatgcgtgggtgcttgtcacgctctcacttgtggtcacgcagattctgcgcgttgattttatcgtgtttttcacgaatgtcatcggtttctcgatgattgcgatccatacgttttcaccgacggatcagcattcggccgctttttccggccagctggtctcagagcttttggtcattcatattacaatggcgattctgtcttacggcgctttttccctttcttttgtcttttcgcttctttatcagtttcaatattctttattaaagaagaaaaagtggggaaaatggctgttgagaattgaagatttgtcaaaacttgattatatggcttacgttttaaatgtcatcggggttccgatgctgctgttgagcctgatattaggcgtgatctgggcgtatgtgtcgctggaaacgctgtactggtttgattcaaaagtgctcggctcgtttattgtgctgcttttatacagctactatttatatatcagattgattaaggaactgcagggaaaagtggcggcgttatggaattcagcatgttttctcgtgctgatgattaattacttcctgctcggaagcctgtcgcaattccattggttcagttaacgaacgcgcccaaacagattcgggaggaaagaaaatgagaacgattaaggtaggttccagacggagcaaactggctatgacccagacaaaatgggtgattaacaaactgaaggaattgaacccttcctataactttgaaatccgggagattgtcacaaaaggcgaccgcatccttgatgttacactgtcaaaagtgggcggcaaaggtttgtttgtcaaagagattgaacaggcgctgctgcatcaggagattgatatggcggttcacagcatgaaagacatgcccgccgttttgcccgagggtcttgtcataggctgcataccgaaacgtgaggacccgcgtgatgctctcatttcaaaagggcatcaaaagctggacgacataaaagaaggaggcatcatcggcaccagcagtttaagaagaagcgcccagattcttgctgaacgccctgatcttacaattaagtggatcagaggcaatatcgatacgagacttcaaaagcttgaaacggaagattacgatgctattattttagcggctgcgggactttcgagaatgggctggaaagatgatgtcgtatctgaatttctcgaaccggaccgctgtctgcctgcggtcggccaaggcgctcttgctattgaatgcagagagtcggatgaggagcttttgaagctgtttgcgcaatttaccgatgagtatacgcagcgcacggtggcagccgaacgggctttcttacacgcgatggaaggcggctgccaagtgccgatagccgggtatgcgtccgtcaatgaccgggatgaggttgaattggtcggtcttgtcgcgtctccggacggaaagacgatttataaagaaacagcggcgggacatgatccggaagaaatcggaaaacgctgtgcggcgatgatgtctgaaaaaggagccaaagcattaatcgacagtgtaaaacaggagctcgatcaggatggcaaatgaccttcctttacaaggaaagaccgtgcttgtcacccggaacaaaagacaggccgcaccgttccgaaaaaaagtggaggcgctcggcggaacggctgtttccgcttcgctgatcgcttttcaggaagcgctcccggatgaatgtgcggacagtctccgggaagacctttctgagccgggatggcttgtgtttacaagcgtaaacggtgtccggttctttttttcctatcttgatcgtcacggtcttgcgctttcgggacggaaaaaaatcgcagccgtcggtgaaaagactgcgcgcgccctgaaagagcggggagcccggacggatgcgatgcctgacgagtatgtggcggaatgtctggctgatactttaaaacggcacgcatcagctgccgaacccatttcagtgataaagggcaatttatcacgcgatgtcataaaagcggagcttgagccgcttggctatcaaataagggaatgggtgttatacaataccattcaggatgaaaaaggcatggacgagctgagacgggctgcatcccgctctcattttgattttattacgtttaccagctcatcggcggtgcatacgtttatgcacgcggtcggagacggagaaaaagcgtgggaaaacagcggtgcgagctatatcagcatcggccctttgacagagaaagcgctcttggaatacgggatctcatcccatgtgcctgacacttatacgattgaaggcatgctggacgtcatgtgcagcatgtcgggaaaggattgataatgatgaatcaaacatttaacagacaccgccgtttgcgcgcgaacgctgcgatgagagatttagtaaaagaaacacgtcttcacccctcagattttatttacccgttatttgtcgttgaaggactcgaaggaaaaaaagaagttccttccatgccgggggtttatcatgtatcactcgatttgttaaaggatgaaatggctgagctgatatcgctcggcattaagtcggtcatcgttttcggcgtgccggaagaaaaagacgcctgcggaacccaggcttttcatgatcacggcattgtgcagaaagggattgctgaaattaaaaagcattatcctgaaatgatcgtaatcgctgatacgtgtctctgtgaatacacggatcacggccattgcggggtcgtgaaagacggagaaatcctcaatgacgagtcgcttgaactgctggctcagacagccgtcagccaggccaaagccggcgctgacatcatcgctccttcaaatatgatggacggttttgtcacagtgatcagggaagcgctcgacaaagaaggattcacgaatattccgatcatgtcttatgccgtaaaatattcaagtgaattttacggtccgttccgcgacgcggctgacagcacgccgcagttcggagaccgaaaaacatatcagatggatccggccaaccgcttggaagcgctccgtgaggctgaatcagacgcggcagaaggcgctgactttttaatcgtcaaaccgtctatgtcatacttagatattatgcgtgatgtgaaaaaccgccatcacctgccgctggtcgcatataatgtgagcggggagtattccatggtgaaagctgcagcccaaaacggctggattaaagaaaaagaaatggtgctggaaattttaacgagcatgaaacgtgcaggagccgatctgattatgacgtatcatgcaaaagacgcagcaaaatggcttgctgagtaacgatttcatttgacgggagctgagacagatgagaagctatgaaaaatcaaaagccgcttttaaagaagcgcagaaactgatgccgggcggagtgaacagcccggtgcgcgcgtttaaatcagtcgatatggacccgatctttatgcagcgcggaaaaggatcgaaaatttttgatattgacggcaatgaatatatcgactacgtcctgagctgggggccgctcattttgggccacacgaacgaccgggtcgttgaaagcctgaaaaaagtagccgagaacgggacaagtttcggagcatctactgaggtggaaaacgaactggccaaattggtcattgaccgtgtgccgtctgttgaaatcgtacggatggtcagctccggcacagaggcgacaatgagcgccctgcgtctggcaagaggatataccggccgcaacaaaattttgaaattcgaaggctgttaccacggccatggtgattcactgctgatcaaagcgggatccggagtggcgacactcggccttccggacagcccgggcgtgccggaaggaatagcaatgaatacgatcaccgttccatacaacgacttggaaagcgttgcactcgcatttcgggagtacggtgaagatattgccggggtcattgttgaaccggtagcaggcaatatgggcgttgttccgccgcaggaaggctttttacaaggacttcgcgacatgacggaacagtatggcgcgctgctcatttttgatgaggtcatgaccggttttcgcgtggattataactgtgcgcaagggtatttcggcgtgacgcctgacttaacgtgtctcggcaaagtcatcggcggcggtcttcctgtcggtgcgtacggcggaaaagctgacattatggaacgaatcgcgccgagcggtccgatctatcaggctggaacattgtcaggaaatccgcttgccatgacagcgggacttgagacgttacagcagctcacacctgaatcttaccaagaatttgtgaaaaaaggcgatatgcttgaagaaggcatttcaaaagcagctgcagcacatggcattccgcacacgtttaaccgggcgggttcaatgatcggcttctttttcacaaatgagcctgtcattaactatgaagcagccaaatcatctgatttaaagctgtttgctaaatattataaagggatggctgatgcaggcgtatttctgccgccgtctcaatttgaaggattgtttctctccactgcgcatacaatggaggatattgaaaaaaccattcaagccgctgagaaagtgttccaggcgatcagccgctgatacagaaaagccgatgcaagcaagacttgtatcggcttttttcaatgcctccattatcatatttttccggattgcggcatacacctttagtgacatctaattgtatggattagatgaaaggaggatatgaacttgccgcataatcaccgattgcaattttctgttgaagaatcaatctgtttccaaaaaggacaggaagtttctgaattactttcgatttcattagaccctgacatcagggtgcaggaagtaaatgattatgtctcaattaaaggatcattagaacttactggcgagtacaacatagatcacagcagtcattttgaagagcttgacagggagctgaggcatgtagaggaagtgagggcgagggaggatggcacggccgagctcattcattgtttcccggtggacatcacgattccgaaaaataaagtgagccacctcaatgatgttttcgtatttatcgatgcctttgattatcagctgacggattcaaggatcttaaccattcaagctgatttggcaattgaagggctgcttgaggaatccgagccaaaagagccggagatccctctgtacgtggcacctgaatttgccagagaagaaatgatcaatcttgccggacatcattcggaggacgaaaacgaaccagaattaatgatacgccatgagcctgaaatacctttgagtgtatcaaaagaagcagcacaagaaaccgagaagaacgaggaagaaaccccgcctttactcaggcaggaggaagaagagcaggaagcagccccgattctgagggagcgggaagaagaagagcaggaagctgccccgcttctgagggagtgggaagaagagcaggaagctgccccgattctgagagagcaggaagaagaagagcaggagactgccccgcttctgagagagcaggaagaagaagagcaggaagcagccccgattttgagggagcgggaagaagaagagcgggagactgccccgattctgagggagcgggaagaagaagagcgggagactgccccgattctgagggagcgggaagaagaagaggagcaggaagctgccccgattttgagggagcgggaagaagaagaggagcaggaagctgccccgattttgagggagcgggaagaagaagagcaggagaccgccccggttctgagggagcaggaagaggtgccgaaacctgtttcctttactgagcctcctcctcccgtttccttccaacaagaagaagagccggaagaagctgaggagcctgcaatcatgtcgtctgtgaggaatgaacctgtatttgaggatgattcagcagaagtgcaggaagagccaaaagatgataacgagccggttttccctgcgttcactctgactccgcatgcagaaaaaccaaaaattgcggaacagcccttccttcaaaaagaagagcagccagaggccgagccgcttctccgtcagagtgatcatgaggcggcagaagacgaagatgagcctgcggtttttcaagaagagcaggcgcccgtttatcgcgagttcgttccggaacggcaggaagaggagttttacagcgctcctaagctgcttgaagaagaggctcatgatgaagaagggtttgaaattgaggtaaggaagatggcgcagccggaggaggaaaccggaaagcctctcgatttgtcttttcagttttccaaactgccgcctgaggagccggcgcaagctgaaccgcctgagccgcttaagtctgaaagaaagaatgaagaagcggcaccgggaaccgagcagaaggaaaatgacaactctcattacttgacaaaattatttacaagggaagaagaaaagttttcaagaatgaaaatttgtatcgtacagcagcaagatactatcgaccgggtgtgtgaacgatatgacataacatcccagcagctcatcagaacgaatgctttatcgtttgatgacgagcttgaagaaggtcagcttctgtatatacctgaatataataacagccatgcgtaagcacaaagaggccgtaaaaatgtggtgaatggaatggaagcagtccaatcagtgcttcaggaatacgggctggcggctgagtatattgagcctgtcagcccgcatgtttggaaggtctactcaaactacggcatttttgctttgaaacagctcaagccggcccgcagcagtgaatttacggatcttatgattgagattgaggagaaaggctaccgatcatttgtgccgatctgccgcacgtatgccggcgatttttttgcgggaagacagacggagaattcttattatttaatgccttggcttcagtacgatcaggaagaggaacgggatcaaaaacatgtttacctttttaaagaggtcgcgaagctccactccgcgactgtgcgggacatccaaatccggactgaagatatcagcggcttttatgaagcaacgaaaagagattgggaaaatgataagcttgtctatgaacaattcgccgaccgggcggaaaaagagtggtatctttcaccttttgaactgcaggctgttacgtatcttacagaaacggtttctgccgtcaattttgctctcgaacgtctggaagaatggtttgacgcggcaaaggatcatgacaagacgagagcggtgatcaaccacggcagcttatcgagccgccactttctgtataatgatgcgggatcgggctttttcacgaatttcgagaaagctgcgctgggccctccgcaaaacgacctgctcggcttttactccagaatgttcagaagctatccgaaagcatgcccggaatgtctggactggttttatacgtatcacaaatcattcccgctccgtgaagcggaaatcagtctgtttctcagctatatggcttatccgtccgccatgtacaaagtgctgaaacggtatcagaccggccaaaggggctctgaaaaagaagagtgcacgcaattattaagagcgttttggcagatgaaaaatgttgagccttttctcatgaaggttcatcagattgagcgggagaaaaaaataaaagcggaaaacgagtcctcttcataacgggactcgtttttttatatccattccaaatgcagggcgcacgctaaaaacagcaggatggcaagcagcaggacatcaaaagtcgtcggaaagaaaatcgtcctgatcccctgaaagatcgtaatcgggataatgacttgcacggatacaaggcggacctgtctggcccactgggggagcgaataagaattgaatttttttctcacgggcaattcctcctcacattcgcctttctatgtatcgtatgtaagggaaagggcggggtgcatgcccatttatgtatgaccgcagcggtttttggaaaagatgattgacgaatcaaaaacacttttactataataaagaacataataaataaaatcatgagctgatataaatacacctgctttgaacgggaagagtacaagaaagacgcatgaagagagagaagctactgtgctgaaaggcttcttatgccgtctcattggaaggtcgcccgggagcataatttcttgaacatacagtagagaaattcgggccgcacccgttatccgtttaagtgcatgaacaaatctgttcatgaaaaaaggtggtaccgcgaaagagcttttcgtcctttatcaggatgaaggctcttttttagttgctcagccatttctaaacatgctggagggttatcatggatacaaacgaacaaacaatgccgacaaaatatgatccgtctgcgattgaaaaaggccgctatgatttttggctgaaaggaaaatattttgaagcgggcggcgatcaaacgaaacagccgtattctgtcgtcattccgccgccgaacgtgacgggcaggctgcacctcggacatgcgtgggatacgacgctgcaagatatcgttacgcgtatgaaacgcatgcagggctatgacgtgctctggcttccgggcatggaccacgccggcatcgccactcaggcaaaagtcgaagcgaaactccgcgaacagggcacaagccgttatgatctcggccgtgaaaagtttttagaagaaacgtggaagtggaaggaagagtatgctgatttcatccgcagccaatgggccaagatgggactcggactcgattattcacgcgaacgttttactcttgatgaagggctgaacaaagccgtgcgggaagtattcgtcaagctgtacaaaaaaggcttgatttacagaggcgaatatatcatcaactgggaccctgccacaaaaacggctttatccgatattgaagtaatttacaaagacgtacagggcgcgttttatcatttgcgctatccgttagcagacggttcaggcttaattgaaatcgcgaccacccgtccggaaacgatgcttggcgacacggctgtcgcggttcatcctgaagatgagcgctacaagcacttaatcggcaaaacggtgattctgccgattacaaaccgcgaaattccgatcgtcggcgatgattatgttgatatggaattcggatcaggggccgttaaaatcacgcctgcccatgacccgaatgactttgaactcggaaaccgccacaatttagagcggattctcgtcatgaatgaagacggaacaatgaatgaaaaagcgctgcaatataacggcatggaccggtttgaatgccgcaaaaaactcgtcaaagatcttcaggaatccggtgttctctttaaaatcgaagaccatatgcattctgtcggacatagtgagagaagcggcgccgttgttgagccgtacctgtccacgcaatggtttgtcaaaatgcagccgctggccgatgctgcggttgaccttcagtcaaaagaagagaaagttcacttcgttcctgaccgtttcgagaaaacgtacctgcactggatggaaaatatccgtgattggtgtatttcccgtcagctgtggtggggccaccgcatcccggcttggtatcataaagaaacaaaagaagtgtacgtcggccttgaggcgcctgaggacagcgaaaattgggaacaggattcagacgtgcttgatacatggttcagctccgcgctttggccgttttctacaatgggctggcctgatgaaaacgctgaagactttaagcggtattactcaaccgatgttcttgtgacgggatatgacatcattttcttctgggtatcccggatgattttccaaggtcttgagtttaccggtgagcgtccgttcaaagacgtgctgattcacggcttaatccgtgacgagcagggcagaaaaatgagtaaatcccttgggaacggcgtggacccgatggatgtcatcgacaagtacggagcggattcactgcgctatttcctggcaaccggaagttcaccgggacaggatctccgtttcagctatgaaaaagtggaatccacatggaacttcgcaaataaaatttggaacgcctcccgttttgcattaatgaacatggacggcatgacgtatgacgagcttgatctgtccggtgaaaaatcagttgctgataagtggatcctcacaagactgaatgaaacgatagaagacgtaacccagcttgcggatcgttatgaattcggcgaagtcggacgccacctgtacaactttatctgggacgatgtgtgcgactggtatatcgaaatggcaaagcttccgctgtacggggaagatgaagcggcgaagaaaacaacccgttctgttctggcatatgtgcttgaccagacgatgcgtcttcttcacccgtttatgccattcttaacggaagaaatctggcagcaccttcctcatgaaggcgagtcaatcacgatcagctcttggccggttccggtgccggaacatacggataaagaggcagcggcggatatgaaactgctcgttgaattaatccgttctgtccgcaatatccggagcgaagtcaacacgccgatgagcaagcaggttgagctttacattaaaacagctaccgaagacattgccggccgccttgagaagaaccgttcttacgttgaacgctttacgaatccgagcacgctgaaaatcgggacggatatcactgcggcagacaaagcgatgacagcggtcgtcaccggagcggaagtcattctgccgcttgaagggctgattaacattgatgaggagatcgcccgtctgcaaaaagaattcgacaagctgacaaaagaggtcgaacgcgttcagaaaaaactcggcaacgaaggattcattaaaaaagctcctgagcatgtcattgaagaagaacgcggaaaagagaaagactacacggcaaaacgcgaagctgtccggcagcggattgcagagctgaaaggctgataaaacagcggggcggtttcctaagaaaccgccttgtcgtataaaagaggggatttcattgtttaatacgtacaaagaagcgatcagctggattcacggcagactcaagttcggcgttaagccgggccttctccgtatggaaaagctgatggaaaaactggaacacccggaaaagaacattcgcgccattcatgtggcgggcacaaacggcaaaggatcgaccgtcgcttttatccgttccgtgcttcaagaagccggttatacggtcggcacgttcacatcgccttacattattacgtttaatgagcgtatcagcgtcaacggcacgccgatttctgatgaggaatggagaacgctcgttaatgacataaaaccgatagtcgatgagcttgataagaccgatgccggaacggtgacagaatttgaaatcattacagcgtgtgcatttttatattttgcgaagcgggctgatatcgattttgtcatttttgaagcggggctcggcggcacatttgattcaaccaatattgtgaatccgctcctgtcggtcattacaagtatcggacatgaccatatggcgattttaggaaataccatcgaggagatcgccgggcagaaagccggtatcattaaaaattccattccggtcattacgggcgtcaatcagccggaagcactcggcgtcattgaagcggaagccgaaaaaaagcaggctccgtatcagtcactatataaaacgtgcagactgtttaatgaagcggcgcttccgtccggtgaaagcttttcgctggaaacggaaacgaaatgctatgaaaacattcaaacgtcgctgatcggcattcaccaaagacagaatgcggcattggcgatattggccgctgaatggctgaatcgcatggaagccgcagccattactgaagaagcgatacgaaacggcctgaaaaaagcatcgtggccgggccggtttgaacgtcttcaaagccgccctttagtgtttgcggacggcgcgcataacgaagagggcgttgaaacgctgacagaaacgatccggcagcgctttgccggtaaaaacgtccatgtggtattcagcgcattaaaagacaaaccgtatcaggaaatgattaaaaagcttgaaaccgaagcggattccattcactttgtatcatttgactttccgcgtgcttcaagcgccgaagccctttataacgcaagcagtctagcggataagagcttcgatgagaacccggacagtgtgaaagaatggatagaacaaaaagacggggcggatgatgtcatcatcattaccggctccttatattttatttcagaaatgagaaagcggcttatctgacagcccctcggatgcccggcggaccattttacggttttgccgggtgtttttatgctgaaaatatattttcagccatttcagtcatggtgtttttctttgctataatctgagccagattgataagtaaaggtgtggtctgagtgcttttaattctgttttttctcggcttgattttcggttcttttttttatacagcagcgtgccgtatcccgcttcgaatttcggttatttcgccgcgttcagcctgttcgttttgccgcttgccgctctcttggggggagcttgtgcccgtcgtttcctatattctgcaaagaggcagatgcagaaactgccgtgcaaagctgtcggttatgtatccggcggcggaatgctggacggcgtgtttattcacggctgcaggcattcatttcggtttctcaaaagaactgttagtcgcgctgttatttctgtctctgctcatgattgttaccgtgacggatctgcaatatatgctgattcctgacaaggttctgctgttttttcttccgctttttatcgccggccgtatgttttctccgctggattcatggtatgcagggtttgccggagccgtttgcggattttttctgcttgtttttatcatgtttgtcagtaaaggaggcatcggcgcaggtgatgtgaaactgtttggggtgatcggcctgacgctcggcgtgaagctcgtgctcattgcattctttctttccgttatgatcggagccgtatacggtatgtgcgccgcagcccggggcaggcttggtaaaaagcagccatttccgtttgcgccggccatctcagccgggagcgctttgagttatttatacggtgaagagctgttttcgttttacatcaagctcgcttcaggcggggcttgaaaaatttggcgaacgttttttggacaagacgacaaaagtcttgttcttttttttttcgcctatgctaaagtgtgaaccatgatcagttcaaagtacggccaagacgaatgcaagggggaagagacgttgaaaaaaaggaagagcaaaaagcacagcaacgcaaaaaacaatgcccttaaagtaaccattaacggacaagaagaaacgatgtatggacaagaagatgtgaaagaaggcggggagaaaaccgtcacattttcaaattgggaagaaacaaaaaaggcggagcaggagaccgctgcatcccatgaagatccgaaagaagaagatttcaattgggatcatgagaagaattctgaggtatttgaagatgacccgaaagtcgttccgccataccagaagaaaaaaaacggccctcattttccgaaaaaaaagcagccgtcttctccagttaaaaaagcggtcacgacaattgctgttgcggctgttttaggcaccgggctcggccttgtcgccttaaatatgtcgggaagtaaagaagcctccgctccagcatcagctgacaaaggttcacaagggcagacggcgaaagcgggagatgtttctaaagacaaatctgaaacagccggcacaggagatgcggaatcttcagagggaaactataaaacatatgcggtgcaggccggaaaattttcatcagaaaaaggagcgcaaacccttgttgaccagctgactgaaaaaggatactcggccgtctctctggctaaagaagacggatacacatacgtgatcgccgggcttgcagcggaaaaaagcctatcacagcaattgggtcagacactgatagaccatgattttgaggcttggggcggaaaagagctcagctttgcggtcgattcaggactggaagactcttttaaacaagcatctgagctctccgccaaagcgattaccggcaaagatctttcaaaaacggaagtggctgaagcggcaaaagcggcagacggtgcagacgccgctgacaaaaagcagaaagaggccgtgcttcaagcgctgaaagaactggaaacgccgggttcggaatccggctggaaagcccaaaaagagcttttaagtgttgtaaaatagtatctcatttcccgtcatccggcgggattttttattttgtcatcaaaaagttatttttctgaaattgtggttgcccgtttgatttggtaggatagacaagtatctttttttcttaagcaaaccctgaaaggatgacaatcatgacaaaacgcttaatactcgcatcacaatctccgcgaagaaaagaactccttactcttcttcagattccttacagcattattgcaagccgcacagaagaaaaattaaatcgaaacctttcgccggaagaaaacgtccaatgtttggccgagcaaaaagccggtgctgtattggccgaaaatcccgatgcagtcgttatcggggctgacacgatggtgtgcatagacggcgaatgcctcggcaaaccgcatgacagagaagaagcggcacacatgctgcggaggctttccggccgaagccatcaagtcattacggcggtcagcattcagacgcatgaccggaaagaaacgttctgtgacacgacggaagtgacgttttggccgctcagtgaagacgacatacagctctacattgaaacaaaagaaccgatggataaagcaggtgcatacggcatccaaggaaaaggcgcgcttttagtgaaaaaaatagacggtgatttttattctgtcgtcgggcttcctgtcgctaaaacaatgagagccttgaaagaatttaatataaaagcttgatgttcaaaccgggaaggggaacaaggaggggttgatcatccgtgatctgccgttaaaattaagagatttccccgaaaaagaaaaaccgagagagcggcttctgcacttcggagccgaacatctctctaacaatgaattgctcgccatcctgctgcggacgggaacgaaacatgagtccgtcatgaacctcgctcaccggctgctgcggacgtttgacgggctgcgactgttaaaaggcgcctctgcccaggagctttccagcattccgggaatcggcacggtgaaagccgttcagattcttgccgcaattgagctggggagccgcattcataagacatccgccggggagcattgcgtcatccgctctccggaagacggggcgaagtatgtgatggaggatatgcgctttttatcccaggagcattttgtctgtttatatttaaataccaaaaatcaagtcattcataaacgcaccgtttttatcggaagtctgaattcatctattgtccacccgcgggaggtgtttaaagaagctttcaaacgatccgccgcgtccttcatttgcgttcacaatcatccttcaggagatcctacaccgagcagggaagatatagaggtaacccggcggctttttgagtgcggaaatttaatcggcatcgagctgctggatcatttggtcattggtgacaaaaaatttgtgagtttaaaggaaaaaggatatttgtaacactttttttttcgttgatttaagatataatagattttatgagtttttccctttagggtatttttgctttaagaaaggaagatacatacatatgttcggaattggtacaagagaccttggtatagatttgggaaccgcgaatacgcttgtgtttgttaaaggaaaaggaatcgtagtgagagagccgtctgtcgttgctctgcaaacggatacgaagtccatcgttgcggtcggtaacgatgcgaaaaacatgatcggaagaactccgggcaacgtggttgcgctccgtccgatgaaagacggcgttatcgctgactatgaaacaactgcgacaatgatgaaatactacattaatcaggctgtgaaaaataaaggattgtttgcgagaaagccttacgttatggtgtgtgtgccgtcaggtattacggccgttgaagaacgggcggtcatcgacgcgacaagacaagcgggcgcacgtgacgcttatccgattgaagaaccgtttgcagcagcaatcggcgcgaatcttccggtatgggagccgacgggcagcatggtcgttgatatcggcggcggaacaactgaagtggcgatcatttctttaggcggcattgtcacgtctcagtcaatccgcgtagccggtgacgaaatggacgactcaatcatcagctatatcagaaaaacatataatctgatgatcggtgaccgtacggcggaagccattaaaatggaaatcggttcagcagaaaccggtgaagaaaatgcgtcaatggaaatccgcggccgcgatcttctgacaggtctgccgaaaacgatcgaaattacgggaacggaaattgcaaatgcactgcgtgatacagttctctcaatcgttgacgcggtgaagagcacgcttgaaaaaacaccgcctgagctggccgctgatattatggacagaggtattgtattaacagggggaggcgccctgctccgcaatctcgacaaagtcatcagcgacgaaacgaaaatgcctgttcttatcgctgaagatccgctggattgtgttgcgatcggcactggaaaagcactggagcacatccatcttttcaaaggaaaaacaagataatcaggagttaaatagaagaggtgtatcacgatgccgaacaaacggttaatgctattacttctgtgtattatcatattggtggctatgattggattctcgctgaagaacggccgtaataccacctggcctgaaaagctgatcggtgatacgacgggagtatttcaaaacatttttcacacgcctgccgaatattttgcagggttcttcggggacataaaagacctgaaaaacacgtacaaagaaaacgaacgcttaagacaaaagctggacggacagacacaatatgaagcgaagctccaagaactcaaagatgaaaacaagaagctgcgtgatgaactcgggcatgtcaaatcaatttccgactatgatccgattttagcgaccgttatcgccagaaaccctgatcaatggtacaagcagatcatgatcaataagggaacgaagcagaaagtggccaaagacatggctgtcacgaacgaaaagggtgcgctggtcgggaagatcaaaagcagcggactcaacagtttcacatccgccgttcagctgctgagcgatgttgaccgcaataacagagtggccaccaaaatctccggcaaaaagggaagcaaaggctacggtttaattgaagggtatgataaaaagaaacagactctgaaaatgaccatccttgagccggatgaaaaacgtgaagtgaaaaaaggcgacctcgtggagacatccggaacgggcggcgtatttcctcaagggctgacggtcggggaagtgaccgatgtagaatcagatgcttacggcctgacgaaaatcgcttacgtgaaaccggctgccgacttgtacgatcttgaccatgtcatcgtcgtgaaccgaagcgtagcaacaggggaggaaggatcgtgaaacgtttccttctccctttgattatgattttggtcttttgtgcggaaagcatctataccgatctggtgcgttttcctttcgtttccgtcgagcagcaggtcgttccgcattttcttttgcttgcgctgatttttatgtccgcttatatcaaccaaaagcatgcggtgatctacggtttgattttcggatttctttatgacatcaattatacgggtgttttaggcgtttatatgtttggttttgccggtttatgctatctggcggccaaagcgtttaaagtgctgcagacaaacgccctgatggtcattctggtcgcggtgctgagcgtatgtgtgcttgaattttacgtctacggcattcagacgttaatccgcagcggcacaatgacatttaacgattttgtcattcagaggttcttgccgaccgctttgctgaatattgcgggagccgttatattagtcctgcccttcaggctgttttatataagtctgaagaaagaattaagagatgagtaaaaaggattttatctttttttgacgaaaagagtatgttgttgaggtgaacattgatgaagaccaaaaagcagcaatatgtaacaataaaaggaacaaaaaacggcttaacattgcatctggatgatgcgtgttcttttgatgagcttctcgatggtcttcaaaacatgctgtcgattgaacaatatactgatggcaaaggccaaaaaatcagtgttcatattaaactcgggcatcggtatctgtatcaggaacaggcagagcagctgactgatctgatcgcgtcaaagaaagatttagtcgtgcattcaattgacagtgaagtcatcgccaaagaagaagcgcagcggatgaaagaggagcaggaaattgtttctgtttccaaaatcgtccgttcgggccaggtgcttcacgtgacgggagatttgcttttaatcggagatgtgaatcccggcggtacgatcagagccggaggaaatatatttgttctcggttcattaaaagggattgcccacgcgggttataacggaaataaccgggctgtgatcgccgcatcagaaatgatgccgacacaattgaggatcaatcacgtgttaaatcgctccccagaccacattcaaaaagggaacgacatggaatgtgcttatttagatactgacggaaatatggtcattgaacgccttcagcaattggctcatttaagacctgatctaacaaggcttgagggaggaatgtgaaattgggtgaggctatcgtaataacttcgggaaaaggcggagtaggtaaaacaacaacatctgcaaacctcggtaccgccttagccattttagggaagcgcgtctgtttggtggacacagatatcggactgcgcaaccttgatgtcgtaatgggtcttgaaaacagaattatttacgacttagtagatgtaattgaaggcagatgcaagacgcatcaggcgcttgtcaaagacaaacgttttgatgatctgcttcatttaatgccggctgcccagacaagcgacaagacggctgttgtccctgagcagatcaaatcgcttgtgcaggagcttaagcaggaatttgattatgtcattattgattgtccggccggaattgaacaaggctataaaaatgccgtctccggagctgataaggcgattgttgtgacgacgccggaaatatcagcggtgcgggacgctgaccgcattatcggacttttggagcaggaagatatcgaaccgccgcgccttatcgtgaaccgcatcagaaatcatctggtgaaaaacggtgacacgatggatgtggatgaagttgttcatcatctgtctattgatctcctcggaatcgttgctgacgatgatgaagtgatcagggcttcaaatatcggcgaaccgattgccatgaattccaaaaaccgcgccagcattgcgtaccgcaatatcgcccggcgcattttaggagaatccgttcctttgcaggtgcttgaagagcagcaaaaagggatgatggcgaaaatcaagtcatttttcggcgtgcgttcataatatataccagaatacaaagatctgatgaagcccagcttatcaggtcttttttgtttttcaagagcgcatatttgcaatggacaagacataggatgtacaaacccaacgattgcaaaggatgatggcgatgagtcacagagctgatgaaattagaaaaagactggccaaaagaagaaaacagtggcctgaatcaaaacggactttcgttcaaaacgcccaaacgcagaattttcccgcgtggcagacggtcaaggagcaggaaaagcacaagcttctaccggactacgaatatcaaacggaacacccgcccgaatttaacggacggcatccattgatcagtgctcattctattattttaaaatgcctgctggccgcctgtctcgtactgatctccgctattgcctataaaactgacaaacagccgctgagtcagatcaaaccggcgatcgcacaaacctttcaaaaagaatttcagtttgctgccgtaagcaattggttcgtatcttccttcggaaacccactcgcttttcttacgccgggaacgaaaaagaaggacggtcaggtggcggtcagtcaggatatggccgttcctgccgcggggaaaatccagcaggactttcaaaataacggagaaggcgtcgtcgtcgaaaccgccagcgaagccattgacagcgtaaaagaaggctacattatggaagtgagcaaagataaaaaaacaggactgacggtgaaggtgcagcacgccgacaataccagcagcatttacggccggctaaaagatgttaatgtttcattgtacgactttgtcgataaagggaaaaagatcggttcgatcaagctcaacgataaaagtaaaggccagtactatttcgcgatccaggatggcgataaattcatagatccgatccaggtgatcacatttgatgaataaatggctcatcctcctttttaaaattcatgtccatccttttctttggattatcatggggcttggtcttatgacggggcacatcaaagcgctgctgtgtcttttgctggtcgtatccgttcatgagctggggcatgctgctctggctgtgtttttttcgtggcgcattaaacgcatctttctgctccctttcggcgggacggttgaggtggaggagcacggaaaccggccgcttaaagaggaattcgcggtcattctggcgggcccgcttcagcatgtgtggcttcaggcggcagcctggctctttttcatgtcaggctttgcaagtgagcagacatttgagatgtttaccttttataatctctccattcttttcatcaatcttttgccgatctggccgcttgacggcggaaagttcgtgtttttatacttctctaaacaaatggcttttcaaaaagcgcatctcctcagcctgcagacatcggctgtttccgcgcttttgctctgctgctggattgtgctggccgtcccccttcagatcagcgcatgggtgctgttcgtctttctcgccgcttctttatgggatgaataccggaagcggcattatattcagctgaggtttcttttggagagatactacggcaaaaaccgcgatgtcgccatgctgcatcctttgacggtcgcggccgatgccaaagtaaagcatgtcatggccgaattcaaacggggatgcaagcaccccattatcgttgaaaaagccggcgaaaagctcagccagctcgatgaaaatgaagtgcttcatgcgtattttgccgataaacggacagattcctctatggaagacctgctgctgccttactagaaatagattgacatatccttttggttctgatatattttttaatgttatggatgtagcaccaatgctacaaccgctcgggacaggtgataagagctttaaagccccctgttgctggcgagtcttagtctaataggaggtgcagagaatgtacgcaatcattaaaacaggcggaaaacaaatcaaagttgaagaaggtcaaactgtttacatcgaaaaacttgctgctgaagcaggtgaaacagtgacgtttgaagacgtattgtttgttggcggagacagcgtgaaagtcggcaacccaacagttgcaggcgcgacagttacagctaaagttgaaaaacaaggccgtgcgaaaaaaatcactgttttccgttacaagccaaagaaaaatgttcataaaaaacaaggtcatcgtcagccttatactaaattgacaatcgaaaaaatcaacgcgtaagcatgattgaggcaacaattcgaagatcccggaatgacgggggcatattgtcctttgaaatgacgggacatgccgattttgctgaacatggacgagatctcgtatgcgccggggtcacggctgtcgttttcggagcggtcaatgcggttatcgcgctggctcctctcgaaccgattcttgatataggcgaggacgggggttatttctactttgaattccctgaagccgctgatcaggaagctttgcaaaaagcgcagctgctgattgaaggcatgattgtttctcttgaaacgatcgagcgggattacagtgaacacttacggttgactgcaaaccaaatataggaggtgagttacatgcttagattagatcttcagtttttcgcttctaaaaaaggtgtaggttctacaaagaacggacgtgactctgaatctaaacgtttaggcgctaaacgtgcagacggtcaattcgtaacaggcggatctatcctttaccgtcaacgcggaacgaaaatctacccaggtgaaaacgtgggccgcggaggagatgacactctttttgctaaaatcgacggaactgttaaattcgaacgtttcggccgtgaccgcaaaaaagtgagcgtatatcctgtagctcaataatgacacaaaaaactccggtcgttgactggagttttttttgcagtaagcggagtaacatcaagaatgaaaagcagaggatgcgtgagtgaaccccgccttgaatgaggacatcagcttcccatacccactggatatgttccccaagcagtgataccaaaaatgtttctgcctggcatccgcattgtatgcgatccgaaaaaggaacatgatgaaccaggaaaaacaagtgtttttttaacaaagccttctctgttataattcatagtacacacttatcaagactcctaaaaagaaattaaacgattgggagtgcgaaaatgaaggatgtatcgaagaaacaagaagaacctgtaagcgatgcggctctgatcaatgagctgatccaattaatgggccatttccgtcatgattggatgaataagctgcagctgataaaaggaaacttaagtttgcagaagtatgacagggtcgttgaaattattgacgaaatggtcatagatgcaaagcacgaatcaaagctctcaaacctgaaaaccccgcacttggcgtttgactttcttacatttaattggaagtcccgttatatgaggctcgaatacgaagtgctcggagaaattaaagatttatcggcatatgatcaaaagctgtcgaacctgatgagaaaactgtttcatctgttcggtctggcggtaaacaatgaaagtgaaaatcatctgaccgtatcgctgcagacggatcaccctgacagacagcttattgtatatctcgattttcatggaacgattgcaaatgcagatgtgtttgatgaatttcgcaaatcccggcatgaggactttgatgtcatgcaatttgagctgaccggccatgaatgtgtggccgaaattggaatgaactagcggttttttacggtttagaacggaggatattatgtttgtagatcaggtgaaagtatatgtaaaaggcggcgacggcggtaacggaatggttgcgttccgccgtgaaaaatatgtgccgaaaggcgggcctgccggcggtgacggaggtaatggaggcgacgtcgtttttgaggttgatgaaggactgcgcacgctcatggacttccggtaccagcggcatttcaaagcgatacgcggcgagcacggcatgtctaaaaaccagcacggcagaaatgcggacgatatggttgttaaagttccgcccggcacagtcgtaacggatgacgatacaaaacaggtcattgccgatctgacagagcacgggcagcgcgccgtcatcgcaaaaggcggacgcggcggacgcggaaatacccgctttgcaacaccggccaacccggcaccgcagctgtcagagcacggagagcccggaaaagagcgctatatcgtgcttgaactgaaagtgcttgcagacgtaggtctcgtcggcttcccgagcgtcggaaaatctacgcttctgtctgtcgtttcatcggcaaagccgaaaatcgccgattatcattttacaacgcttgttccgaatctgggcatggtggaaacggatgacggaagaagcttcgtcatggcggatctgcccggcctgattgaaggagcgcacgaaggagtcggcttaggccaccaatttctccgccatatcgaacggacgcgcgtcatcgttcacgtcattgacatgtcagcgatggaaggccgtgatccgtatgaggattatgtcaccattaatcaggagctcagtgaatataatctgcggctgacggagcgtccgcaaattatcgttgcgaataaaatggacatgcccgaagcggctgaaaatcttaaagcgtttaaagaaaagcttcaggatgatcaccctgtctttccgatcagcgctgtgacgagagaagggctccgcgatcttctgtttgaagtcgccaaccagctggaaacaacgcctgaattcccgctgtatgatgaagaagaactggcggaaaaccgcgtaatgtacacgatggaagatgaagaaattccatttaacattacccgtgatccggacggcgcgtttgtgctttcaggtgacagtctggaacgcctctttaaaatgactgacttctcccgtgacgaatccgtcaagcgttttgcaagacagatgcgcggtatgggcgttgatgaagcgctcagagaacgcggtgctaaagacggcgatatcatccggcttctggaatttgaatttgaatttattgattaaaaaaacggagagcttgcgttgcaggctctctgatgtaaaagggaggggtgcaggtgaaagaagagacattttatttagtgcgtgaagacgttctgcctgatgcgatgcggaaaacccttgaagtcaaaaagctgctcgacagaaaaaaggctgaatcggttgcagatgccgtgcagagagttgatttaagcagaagcgctttttacaaataccgagatgcggtttttcctttttacacgatggttaaagaacaaataatcacacttttctttcatttggaggatcggtcaggcgcgttatcccagcttttgcaggcggtggctgactcaggaagcaacgtgctttccattcaccagacgattccgcttcagggcagggcgaatgtcacgctctcaatcagtacgtccgcaatggaagaaaacattcatacgttaatgaataaactgagaaaatttgattttatagaaaaagttgagatcttagggtcaggcgcgtaaggagagaagagacatgaaagtcggttatttagggccagaagccacatttacacatctagcagtcagttcctgctttcaaaacagcgtgacacaagcaccttatcaaacaataccggcatgcatggatgcggcggttgcgggagaagttgatcttgcatttgttcctttggaaaacgcgctggaaggctcggttaacttaacgattgactatttgattcatgagcagcctcttgcgatcgtgggggaaatgacgctgccgattcaccagcatctgctcgttcacccttcgagagaaaatgagtggaaaaaacttgagaaaatttattctcattcccatgcgattgcgcaatgccacaaatttcttcaccggcatttttcgtccgttccttatgagtatgcgaagtcaacaggtgcggctgccaagtatgtcagtgagcattcggaccttccgatcggcgtgattgcaaatgaaatggccgccgctacatacggattgagcatcgtgaagcgggatattcaggattatcaggacaaccacacgagatttgtcattctttcgcctgaaaaagacgtctcattcgaagtgaatgcgaaactgtcttcacggccgaaaacgacgatgatggtaacgcttccccaagatgaccaatcaggtgcgctgcacagggtgctgtccgctttttcatggagaaacctgaatttatcaaagatcgaatcgcggccgacaaaaacgggtctcggcaactatttctttattattgatattgaacaggcgatggatcaggttctcattcccggtgccgttcaagagatggaagccctcggctgccgggtcaagcttctgggaacatatcaatcctattcgatataaaaaaagcccttcagggggcttttttttaatcttttattaaaatacccgcgtcgtccagcgcttggcaggcttggtcaatccgctcttttgtcggggcgcttaacgtatggaggtgcacgcctccggtcagctgtgaaaggtaagcggcatttgtcgagttaatgtgatccatgaattgtttgacttctttccgtgtactgactcttatggcggcggttaaatcgccgtatacggggtgttcaattatgacgtcctttatggtgacgccttcatcgacaataagtgcaagctcttcttccgtccgctccgggccgtgcagacaggcgacaatccgttcggcatttttttcgccgccggcattcatgctgatgtataagtagccttggctcgtcgcgataatcggctcgttttttgctttcaaaagcgatatgtcctgcacgatcacctgtcttgagacatttgcttttttggccaattcgcctcctgttaatggcgagccggcttctttcagccaatgaagcagcatgtcgcgtcttttctccccagtaagcttcgttccttctgtcaaattgctgattctcctttcttttgctcccatagcgccgtaaatgtatgtatcagcatatcgagctgttcacatgttgtttcgtttccgaatgagatccggaaaaactgccgcgcttcccgttcggtttttctcagcgccttcatagctgaagaagggccgtggctgccggcggaacatgcgctcccggttgagatgcaaatatcgttacgattacattctaacataatatattgtccttcaaaggagtgaaaaaaacacccgacaatgtggggcaggcattcaccgccggtttcttcctctgaaaatgaaatggggaggccttgacgccgaatttggtcatacaaataattcctcagcctgtcagcatgctcacggtgttcctccatatgtttcactgcatactccgcagcagcggtaaaagcgccgatggccggcacattcaccgtaccgggcctgaacccgttttcatgcacggtatgcggataaaccgggttccagctgacaccgggccgaatgtaaacagccccggtgcctttcgggccgtatactttatgaccggagatggaaagggcgtcgattcccgcctgatccgcatcaatcggcagtttgccgaaactttgaacacaatcgcaatgcagcaaaatgtttctctggtgaagaaaagcggccagacgattcacaggctggatgaggccggtttctgaattggcgtgctgtatggaaacgagccccgtgtcaggacggacatgagccgccagtatgtcctcggttataaggccgttttcgtcgggatatatgatggtgacatcaattccacggtcagctaaaaacgccgcggcattatggatcgaatggtgttccattgcggtcgtaataaaatgttttttgtgatcgggcaggccgtgcagcaatgattggacggccaggatgttcgcttccgttccgccgcttgtaaagtaaatgccgtctgccgctccgccgatcaatttgcctgcagaatgtctgcaatattccagcacgtccgccgctcttcctccggcgtcatgaaggctgcttgcattgccgtatacctctgtgctgagatgctgaaagactttcgcggcttctttgcttaaaggcgctcccgccgcgtaatcaagataaatcatacagcccgtctcctatccgtttatgttaaaaaaagcttgagtttattttatcgttgtgtaaatataggtgtcaagacaggtgtaaacataacaggagggtgatgtatgtctgaaaaaacaattatcgtcattggttcggggacggcggcccttgcctgtgcttcctcatttcctccgtcataccaagtgaccgtcatcacaaagagaaacgtaacgaacagcaattcgcattatgctcaaggcgggattgctgtttcatatgcaaaagatgactctatagaatcccatgtgaacgatacactgtatgcgggatgcggacacaatgacgtgacagccgtgcggcatttgctgaaaagcggacaaagcatgataaacaggctgatagaaggccatttcccttttgatacgaagtcggacggaacgttttgtctcggcagggaaggcgctcattccaaaaggagaattctgcacgccgggggagatgcgaccggacggatgttggttgagtttctggttcagcagctgagggacggcatacggatcattgaacacgagacggttgttgatctgctgattgaacacggacgatgcgcaggcgttgccgcaaaggatgcttcaggcgctgtttcttacagaagagcggattgtgtagtgcttgcatcaggcggctgcggcagtctgtaccaatatcacacaaatgattccgccataacgggagacggcatcactcttgccttccgcgcgggagctgagatcacggatatggagttcacccagttccacccgaccctccttgtgaaaaacgagactgtgtacggcctgatttctgaagcagtgaggggagaaggcggatatttagcggatcgcttcgggcgcaggatcatggctggcagacacgcgcttgaagatttggcgccccgggatgtggtttcacgggcgatttatgaagaaatgatgaaagaaaatcctgtttttataaattgcagccgaatagccgattttaagaaacgttttccgaccataacagaaatttgtcaaacagccggtgttgatcttgaaagcgggattcccgtagcacccggaatgcattttttaatgggcggagtaaaagccgatacatgggggaaaacgtccgtgcctgatttgtacgccataggcgagaccgcctgcacaggattgcacggggcgaaccgccttgcgagcaactcactgctggaagcgctggcaagcgggaaacgatgtgctgaacatatcactcaaacaccgttaaacggaagatataaaaaaaccccgaagaaatctgacgtcatcttagaagtgccggacacaacgcttcatgtgctccaagccaaaatgacaaccggagcgggcattgtcagggaaaaagaaaacctgcaggcgctggcatcctggcttaacaacgtatctgtgcgtcatataaatgtgaaggatatcacaatggaacaagccgagctatcctgcttatggaagactgcgcaacttgttgtgacctcagcccttattcgggaagaaagcaggggcgctcattttcgcgctgattttcccgggacggagaaagagtggcacggaaaacaaatcattcattcaacatctggaacagctatcagaaaaaacgaaaggattggggaactatggacattctgcagctaaaacaaatgctgactcatttttttcaggaagatatcggaacgggtgatgcgacgtcacaagcgattttttctgatcagcaatgtaaagcgcgaatcatcgcaaaaacagacggcgtgtttgccggagaagccgttatccgtgaaggatggaagcttttacacgatgatatccgcatccgctccctgaaaaaagacggagaacggatgaaaaaaggagacgtgctcgctgaaatagaaggccaggcggcggctcttcttacgggggagcgggtcattctgaatctcatacaaagaatgtcaggcattgcgacaatgacggatgaggccaaaaggcgtcttgatgatccgtccattaagctttgtgatacgagaaaaacgacacccgggctcagaatgctggaaaaatacgccgttcgggtcggaggcggctttaatcatcgcttcggcttatatgacggcatcatgattaaagataatcatattgctgcctgcggatcgataaaggcggccgtggagcgggcaagaaaaacggcggggcagatgcttgcggtggaagtcgaaattgaatccgaacagcagctgctcgaggcaatagaagcgggtgcagacgttattatgtttgacaactgtccgcctgagtccgtccggcgttttgcaggcatgacaccgggacatatcaaaacggaagcatccggaggcataacgctcggcacattgcccgcttataaaggaacgggcgtccaatatatttcactcggatttctgactcattcagtaaaaagcgccgacatcagcatggatgttgaggctgcggaacaggggaatttttaagatgtctatttttgacgtgctaactgcatcagccgaaatgatgccgagccattataaagacatgagcacaggagaaatggaaaagcgggtcgccgccattaaacgggctttcggaaagcgcctgttcattccggggcatcactatcaaaaagacgaagtaatacaattcgccgatacggcaggtgactccctgcagcttgctcaagtggcagaaaaaaataaagaggcggaatatattgtgttttgcggcgtgcattttatggcggaaaccgctgatatgctgactgatgataaccaaaccgtcattttgcccgacatgcgcgccggctgctcgatggctgatatggcagatattcagcagacggacaaagcatggcaagagcttcaagaactgtacggtaacaccatcattccgttaacatatgttaactcgacggcggaaattaaagcattcgtcggacggcacggaggagcgaccgtcacctcttcgaatgcccggagtgtgctgaaatgggcttttaaacaaaaagagagaattttatttttgccggatcagcatttaggcagaaatacggcctatgacctcggcattccgctgacagaaatggctgtatgggacccggtgcagaaccgattgcttactgaccatccggaaaacattaaggttatcctttggaaagggcattgctccgtacacgaaaagtttacagcggaaaatatttctcagctgcggcagcgggattccggcatccgcattatcgttcatccggaatgttcgcgggaagtggtctcgctcagtgacgacagcgggtctaccaaatacattattgatacgatcgaacaggctgaaccgggaagcaaatgggcgatcggcacggaaatgaatcttgttcagcgcctcattcacttgcatccggataaacagattgaatcattgaatcccgatatgtgtccgtgtcttactatgaacagaatcgacctgccgcatttattgtggtcgcttgagcagcttgaaaaaggcgagccgaagggtgtcattaaagttccggaagcggttcggacagaagcgcttcgtgctttgaacagaatgctgagtcatacgtaatcataaaaatttcccctccttcccaaattttttatcatcatgcccagtccaccggcatatagtgtgaagaaacgtattgtaatgacaaatgtaccgttcacgttttgtgcataggaggggaaaacgttgaaaattcatatcgttcaaaaaggcgattcgctctggaaaatagctgaaaaatacggagttgatcttgaagagttaaaaaaactgaatcatcagcttagcaatccagacttaattatgcctggaatgaagataaaggtgccttcagaagccgttccggtcagaaaagaacctaaggccggcttcggaacgtctgcgcataagcatgagcatccatatgccaaagaaaaaccgaaatcagttgtggacattgaagacaccataccggaagaaccaaagccgtcaattccgtatgtgccgccaatccctgaaaagcatgaaaatgtgctgccggaagctgatatgaaccaatattacccgtccaatcagctgtttcagccgtggtcgcctcctaagccggaggaaccggtgacacattttgtcgagccgaaagaaaaagagcatgacaataacattccacaacaggaggaaatgatcaacatggaaaacgcgaattacccgaatatgccaaaggcgcctgaagccggaaagatggaagaagaaaacgccgcttatcatctgccgaacatgccaaacattccgaatgtcccgtttccgaatatgccggccgttgaaccgtcttttatgcattacccgatgccgtgcatgccttgtccttgtccggttccggtgacaccgatgctgccgggttcgggactatgccatccgtgcttcccggtaggcggaggtttcggcggttttggaggaggttttggaggctttccggtaatgccgatgccgttaccgtacggattccatcatccgggatttgggccgcaagcgggttacggtgaatttgaaaaccaggcccatgaaaatgcagagcattatgatggttctgcatctggtttcggcggtgctccgtacggtcaaatgccgtattacggcggatattcgtcacattacgcaaacgcgcctcatcatgatggaaaatataaggatgatgattgcggctgccatgattcacatcatcaccaccaccatcaccacggttcacatcaccatcacgcaaatatgcctgtgcagccgtatccgaatatgggtgcaaacgccggatattttatgccttacggcggagcaaatcctagtgccgcgccgaatcagccgagtccaaatcaagtattcggacggccggaggaagaagaagattaatgtttcgggacgatgtatgtcgttcctttttttatgtccaactgaggaatggacataactgacaagcttaaatccgccgcccgccgcacatcctaaacatgagcggaaaacgctcaaaacagcgatgaatccacggggggtttttccattgggtaaaaaactgatgacgatcgcgggcgttttagccgtgacggcaagcttaacggcatgcggagcaaataatgccatgaatgacggacgctacaaccagtcaacacgtccggtcggatattattcgaatgataatggtaacggcagaggccagtacggcatggaccatcaaggacccgtttctgaaatgatggaaaaccgaaacggccgtcataatacgacaaacgtgtccgaccagtacgcgcctaatgacggggttccgttaacgacggacggcacatataacggccgaaatgtcaatacgccgccggcagcaatgtcttataatgggtatgacaacgccgaaaacatcaggttggcggcaaaagttgcaaaccgcgtgaaaaaagtaaacggcgtacaggatagtcaggtcatcgtgactgacacgagagtcgtcattgccgtcagaacaaatcatccttttacgaaaaatgatgataaacatgtcaaacatgcggccaaaaaattcgcggacggccgtacaattcaagtgtttaccgacaacgctacttttacaaagctgcaagacatgaacagaaacagccgttaaacgggactgccggatgatttcatccggcagtatttttatgaataaagcttcatcatttctttacatattcttaaaacgctctttatattgcggtgttaacataaaagtaataaaacgtaacggaggggccgggatgaaaaaaacggagcatgacaaaagccgcggagcaaaaactgtgtatctgaccgtaaggggataccggctcaaactgacgcccggacaaatgaaactgatttcagccggacgggcataatcatcgcagcagccctcatttagagagctgctttttttcggctgaaacagacaaatgaaagaaaacggttaagcaccggcatctttggtcaaactagcatcaagagtttgattgaataaagaggtgttattggtgaaacgaatttgcggtgctcgtctattgtttatgcttatcttatcggctgcagccctgatttgcggaggaaaaggcgcatacggggcggaggtcgagcattacgggccgcttcgggtgcacgtccagctggaaaaggtctatctggacggtgatgtcggcatcgaacatacggatgaaaccgttttggcgatggaggatttttgggccgcatatgcgggctggacgctcgttgagcagaaaaaaggcttcgtccttttccgtaagcatgttgatgacatttctccgctcagtaaggttaacggttatatcggcgtcacggacgggggcgtcatctccacttttcacggccgtcccggatcgctggccgagccgattcaatctttcttccagattgatatagaaagactggaaagccgattgcaaaagcacttggaacacggcataccgtacaggacaaaagcggagtttgagagcgtgatcgatcatattaagacttacagcggctgactttgacgcaagacatgtgacacatgtcttttttttctgaatggaaggtgtcaaagcgaacatacgttaacttttctataagactttggctgtttttgtgttacaatgataagcagtcaaagaggtgaataggtgtgattgaattcgtgaaggggacgattgattatgtatctccccaatacatcgtgattgaaaacggcggaatcggctatcaggtcttcactccgaatccgtttatttataaggtaagcaatcaagagaccatttttacgtatcatcatataaaagaagatgccttttctttgtacggtttttcaacccgggaagaaaaagcgcttttcacaaagctgctgaacgtcaccggcatcgggccgaaaggggcgctcgccatcctcggctccggtgatcccggagccgtcatcgaagcgatcgaacaggaagatgaagcctttttggtgaaatttccgggtgtgggcaaaaaaacggcgcggcagattattcttgatttgaaaggcaaactggccgacgtcgtgcctgaaatgattgacaacctgttcaatcatgaagcgcgcattgaaaaacaagaggctgaaacggcgcttgacgaggcgcttgaagcgctccgggttctcggctacgccgaaaaagaaattaaaaaagtgcttcctcacttaaaagaggaaacggcgctttcaacagatcaatatgtgaaaaaagcattgcaaaaattattaaagtaaggtgatgttcatggatgaacggctcgtttcaagtgaagcagacagccatgaatcaataatcgagcaaagcctcaggccgcagaatctcgcccagtatatcggccaaaagaaggtgaaagaaaatctgcgcgtgtttatcgatgcggcgaaaatgaggcaggaaacgctggaccacgttcttttatacgggcctccgggtctcgggaaaacaacgcttgcgtctatcgtggccaatgagatgggtgtggagatgcggacgacgtcaggtcccgccatcgaaagaccgggggatttggcagccattttgacggcgctcgaaccaggggatgtgctgtttatagacgaaattcacaggctgaaccgctcaattgaggaagtgctgtacccggcgatggaggatttctgccttgatattgtcattggaaaaggcccgtccgcccgctccgtccgtctcgaccttcccccttttacgcttgtaggagcgacgacaagggtcggattattgaccgcaccgctcagagaccggttcggggtgctgtcgcgccttgaatactatacgcaggaagagctgacagatatcgtgtcaagaacggctgacgtttttgaagtggatatcgaaaaagccccggctctggaaatcgccagacggtcaaggggaacgccgcgggttgcaaaccgtctgctcagaagggtgagagattttgcccaggtgctcggcgacagccgcatcacggaagaaatcgctcacgacgcgctcgaacgtcttcaagtcgatgcgctcggccttgaccatatcgaccataagctgctgatgggcatgatcgaaaaattcagcggcggtcccgtcggccttgatacgatttccgcgacaatcggcgaagaaccgcatacaatagaggatgtgtacgaaccgtatctgctgcagatcggatttcttcagaggacgccgaggggacgggtcgtgacgccggctgtgtatgaacattttcgattggaggcgcccgcccgtgactgactttccgaaggttctcatggttctcggtgccgttttgcttattgccggcgcagtctggcactttgtcggaaggctgcccggagatattttcgttaagaagggaaatgttacatttttctttcccgttgtcacttgtattgtgatcagtgtgatactatccattctgcttaattttttcggcagaatgaaataacaatagacagaattaaggtgaaatgatgaaagtcgatttatttgattttgaactgcctgaacgcctcattgcccaagtgccgcttaaagagcgtgacgcatcgcggctgatggtgctcgacaaacagacgggcgggctgacggacagttcatttaaagagattgtaagcttttttaatgaaggggattgcctcgtcttgaacaatacccgtgtgctgcctgcaagattattcggcacaaaagaagatacgggagcgaaagtggagcttctgttattaaaacaggaagaaaatgatacatgggaaacgctcgtaaagccggcgaaacgcgtaaaaaaaggaacggtcctgacatttggcgacggccggctgacagcggtctgcacggaggagcttgatcacggaggcagaaaaatagaattccggtatgacgggattttttacgaagtgcttgaatcactcggtgaaatgccgctgcctccttatattaaagagcagcttgatgataaagaacggtatcagaccgtcttttcaaaagaaatcggatctgccgcagctccgacggccggacttcattttacggaagagattctggacgagctgaagcaaaaaggtgtgcggattgaatttatcacacttcatgtgggactcggcacattccgcccggtcagtgcggatgatgtggaagagcataacatgcacgcggaattttatgaaatgacggaagaaaccgccgcctctttaaacgaggtcagaaaggcgggagggcgcattgtgtcggtcgggacgacatccacgcgcaccctggaaaccattgccggcgagcatgacggcgtatttaccgcttcaagcggctggacgtccatcttcatttatccgggatatgaatttaaggcgattgacgggatgatcaccaattttcatctgccgaaatcttcccttatcatgctcgtttctgcgcttgccggcagagagcatgttctttccgcctaccgtcatgcggtagaagaggaatatcgtttcttcagctttggcgacgccatgctgattatctaatttgaatgacaggaggcctcatacaaagtggctgaacaaccgatacgttatgaatttataaaggaatgcaaacaaacgggagcgcgactgggcagagttcatacgccccacggctcctttgagacgcctgtatttatgccggtcggcacgcttgctacggtaaagacgatgtctccggacgagctgaaatctatggatgcgggcattattttaagcaatacgtaccatttatggctccgcccgggacacgacattgtaaaagaagcgggcgggcttcataagtttatgaactgggaccgcgcgattttaacggattccggcggttttcaggtcttttcattgagcaagtttcgtaatatagaagaagaaggcgttcatttccgcaatcacttaaacggagacaagctgtttttatctccggaaaaagcgatggaaattcaaaacgccctcggctctgatatcatgatggcgtttgatgagtgtccgccgtatccggcagagtatgattacatgaaacgctctgtggaacggaccagccgctgggcggaacgctgcctggaggcgcacgggcgctcagatgagcaggggctattcggaatcgtacagggcggagaatacgaagacctgcggacacaaagtgcaaaagacttggtttcgcttgattttccggggtatgccataggcggattatctgtcggcgagccgaagcacgtcatgaaccgagtgcttgagtttacaactccgcttttaccgaaggacaagccgagatatttaatgggtgtgggttcaccggatgccttaattgacggcgccattcgcggcgtggatatgtttgactgcgtactgccgacccggattgcccgaaacggcacggtgtttacgaatgaagggcgtctgaatatgaaaaacgccaaatatgagcgtgatttccgtccgattgatgaagagtgcagctgccatacatgcaaaaattactcccgcgcttacatcagacatttgatccgctgtaatgaaacgtttggaattcgattaacaacttaccataaccttcattttctgttacacttaatggagcaggtcagacaagccatccgggaggatcgtcttggtgatttccgagaagagttctttgagcgttacggctataataagccaaatgcgaaaagcttctaaataaaaccattcttgaagggagggaaacagatgggtactttaggtacaatcgttcctattattttaatgtttgcagtgctttatttcctgctcatccgtccgcagcaaaagcagcagaaggccgtacgccagatgcaggaagagctgaaaaaaggggattcagtggtgacaatcggaggattgcacggcactgttgattcaattgatgaaagcaaggtcgtcattaaaacaggtgataacacccgtttaacatttgaccgccgcgcaatcagagaagcttccgctgaataacagcgaagctcatacatacaaaaaaagagcggagaatccgctctttttttattacgctgatctgcttcctttcaaattcactccgaaaatgccgcccagcatactgactcccaaaaagccgagatgaaacaaaagctgaccggatgtaaacgtttttccgaaccctaaatattgaaacagcaagatgattaatgaaaaacagacggcggttaacgctccgatcatccagcctttttccttcgctttgccgcccgatataaaaccgcccgcaaataaagaaagaaaagaaagcgcggtgatcagccagctgaaagatgattcttccattgaggtaaccgtcagtaaaagcgaaatcgccaaactcgtaagaagcatcaccgcaaagatagccactaagccgtacaagacgcctcttcccacttgtttcgtttcttccatttttatctcctctccgctctgcggcctgatatatgacaagccggagcctgtctttttctaaatgtattctctgaatgttcgaattagacttaaatgcatgatgttcagcccgtttcttacataattcagagccgatggcaaatgctatgaccgttggaggtgcgatatggaagatattttcattattacgtttcgtacgattgtgctttattttatcattcttgtgattttcagactgatgggaaaacgggaaatcggagaactgagcattttagaccttgtcgtctccattatgattgccgagattgccgtattggcaattgaaaatgtaaaagataagcttttgcatacgattgtgccgattgtcgttttaatgattattcaagtaagccttgcttttatttcgctcaaaagccaaaaaatacggcagctgcttgacggaaaacccaccattattataaaacagggaaaaattgatgaacgggcgatgagatcgcagcgctacaattttgacgatcttcttatgcagctgagggagaataacatcgatagaatctctgacgtgtcatatgccattttggagtcttcaggcaaactgtcgatcgtcaaaaagaaaaacaataaggataagcagatggaaacatcgcttatcgttgacggggtcattcagaacgagcatctggacagaatcgggaaagataaacactggctcgaaaaaaatttagcaaaaagaggatatcgcgatttttcggttatatcattctgcacgtttacggacggcgctttttttattgatcttaaagatgaaaaaggggagccatgaatcggtttcaccgcgtcacgaacttgccgatgaccggaatccggatcagctcttcccttttaatcagcctgaataacagaagaagcgctatatacaaaatcgcggtcattgcaatccagcctgtgagattaacagcctctgaccctgaaaaatgaacggcgtgtttgatgatgcggctgacatagccgcaaatgaatatgacggcaaaacagagcgcgtattcttttattttaatgctgatcggaagcaccttgcttacggtggccgcatgcagcagggtgacaagaaccatccccgttacaatcgcaagtgcggcgcccatgatgcccaaggaaggcctggtcgccaaaacaaaaattagaccagttttgacagcggcgccgataaaactgttcatcatggcggccccggctaaattgagagcctgcagcaccgcctgaaggggcccctgaaaatagtaaagcaaaaaaaacggcgccatcactttaacaaataccgccgcattagttgatccgtacatgacggacatcagttcatcagcgaaagagaataaaataaccaccgaaatgcctccgcttaaaagacacagccgcatcgcctgttccagacggtattcgacaacttgcagctttttttgctccattccttcactgatcgcaggaacaagtgccgttgacagagaataggttataaagctgggcagcgtcaaaaccgtcatggcaaatccggtcagctccccgtactggctggtggcggcagcggtggccactcctgcaatcgcaaggctttgcgcgacgacaataggttcaaaaaaccaagataaatttccgatgaagcggcttccggttgttgggagcgacacgctcatcagctggcggaaggtttcttttccatttgcgatcgacttgaaaaattgttttctgattctgattgttttatttgctttaaaacaaatgaataaataaataagagaggcaagctccccgatgacagacgaaatcatggctccggctgcggcatattcaatcccgtacggcagaaacaccgtcgtgcagaccgcgacaagtgaaatccgcacgatctgctcaagcacttgggaaaacgccagcgggttcatattctgccttccctgaaagtaaccgcgcagcacgctggagatcgcgataatcggcacgacgggcgtaatcgccagaagcgggtaaaccgtgcgctgatccgtcagcatcgtttcggacataatcggcgcaaagcataaaaacagcggcgtgaagatgagacttaatatcccggtgacggtaagcgacatcactaaaatatgtttcattttctgccggtccccccgcgcgcttgcttcagcgacaagtttgctgatggcaacggggaggccgaattgagtcaaagtggtggccaagaaaaatgtcggggcagccatcatgtataaaccgaccccttcttcaccgataaaccgggcgataaccacccggttgacaaagccgagcattctcgtaatcatcccggctgcgatgagaataagagtgccccttaaaaaagtctgttttgccattttataaacccctgccttctcaaactacctggaatcatatacaataaagatatgcgccgatgtcgtccgagcatgacaagtcttcgagaaaaatggaaaaaggagcgagcgcccagtggagaaacatcccgccgaaatgtacaaagatcatttgcggcctttcttgtacagtaaacttgaagagttcaaaatcctcggatacgatgatgttgagcacgagagtttatggtcatacttaatacataaaaagtggaaacagaaaaaggaactgccgctgcatgaattggccggtcatattttatcagttaaaattggcgattttatgaactatgcaaccgttgaagcttttaagtcgtctaattggctggaaagcgatgagggtcaggaagctttagatgaactgctgagataatgatttgacggcataggtttaaggaggaaatacataatgaaaaaaggacgcttgattgcgtttttcctgatcgtattattgatcggcacagggctggggtattttacaaaaccggctgccaataatattacgttaggattggatttacgcggcgggtttgaagttctgtacgatgtgcagcccgtcaaaaaaggcgataaaatcacaaaagacgtgctcgtcagcacggtgcaggcgctgaaccgccgggctaacgttctcggcgtaagcgagccgaatattcagattgaaggaaataaccgcatccgcgtacagctggcgggcgtcacgaatcagaacagggcgcgcgaaattctgtcaacggaagcgcagctctcgttcagggatacgaatgataaagagttgttaaacggctctgatctcgtggaaaacggcgcgaagcaaacctttgatccgacgacgaacgaaccgattgtcagcgttaagctgaaggatgcggataagttcggcgaagtgacgaaaaaagtcaagaaaatggcgcctaataatcagcttgtgatctggcttgattaccaaaaaggcgattcttttaaaaaagaagtcggcaaaaaacatccgaaatatgtatccgctccgaatgtgagccaggaattaaacacgaaggatgtcacaattgaaggccagtttaccgttcaaaaagcgaaggacttggccaatattttaaacgcgggcgcgctgcctgtgaaactgaccgaaaaatactctacttcagtaggggcgcaattcggacagcaggctttgcatgatacggtagaggccggcatcatcggtattgcaattgttttcttatttatgctgctttattacagactgcctggactcatagcggtaattacgctttctgtatacgtgtatattacgcttcaagtgtttgactggatgcaggcggtgctgacgcttccgggtattgcggcgctcattttgggtgtcgggatggcggttgacgccaacatcatcacctatgaacggataaaagaagaattgaaactcggcaaatccgtccgctcagctttccgttcagggaacagacgttcattcgcgacgattttcgatgcgaacattacaacgatcatcgcagcggtcgtgctctttattttcgggacaagctctgtaaaagggtttgcgacgatgctgattttgtcaattctgacaagctttattacagctgtcttcctttcaagattcctgctctcccttctcgtggaaagcagatggcttgaccggaaaaaaggctggttcggcgtcaagaaaaaacacattatggatattcagaagaccgacgaaaatactgaaccgcatacggcattccaaaaatgggatttcacgagcaagcgaaaatatttctttattttctcaagcgctgtaaccattgcgggaattatcatcttactggtctttaaactcaacctgggaatcgattttgcaagcggcgcgcggattgacgtgcagagcaatcatgcattgacggcgcatcaggttgaaaaagattttgactctctcggcatggaaccggaaaacatcgtgctttctggtaaagagaaccatgttgccgcggcccggtttgtcggagagccatctaaagaaaaaatcgctgaaatcaaaacgtactttaaggacaaatacggatctgaaccgaacgtcagcacggtatcgccgacagtcggaaaagaactggcccgtaatgctttatatgctgtcgccattgcatcaatcggcatcattatttacgtgtcaatccgtttcgagtacagaatggctatcgccgcaattgtatccctgctgtacgacgctttctttatcgtcgcgtttttcagcattacaaggctggaggtcgatgtcacctttatcgccgctattctcaccataatcggttactcgataaatgatacgatcgttacatttgaccggatacgtgagcagatgaaaaaacgcaagccgaagtcatttgccgatctggaacatatcgtgaatctgagcttgcagcaaacctttacacgttcgatcaatacggtcttgaccgttgtgattgttgtcgtcgtgctgctcattttgggctcatcgtcaattacaaacttctccgtcgccttattggtcggtttattgacgggcgtttattcctctctttacatcgccgcgcagctgtggcttgtatggaaaggtaaagaatttaaagggaaaaaatcaatcgaagagtaaaatgggaacaggctgtcttccggaaggcagcctgtttttttaggccgcattgaacttaaaacctgcatttgctataatgacatacgcttacataatcaatcatcattgtaaaaacatgtaggagggttcttatgaacgttcgtgagtcggagcttccgggcatcggccagaaagtagaagtcattacgaaaaatcacgataaaatcagtattattcttcatgatgacggcagaaaagagctctattacttcgatgagaatgatcatgacgaatgcttggcatccgttgaatttaacgacgaagaggcgaggcagatttccgctattttaggcgggatgacgtataagccgaaagcgctggaatctgtggaagttgcgcttgatgacctcgtcattgagtggtttaaagccgaatctcatgcaccggctgtcagccgtacaatcggagatttggagatcaagaaacattacaacgtccagattattgcgatcataaagaaaaaccggcaaaaacagctgagccccggcattgataccgtaattgaagaaggggacaccctcgtcatatcgggagaaagaagcggactgaaaaagctggtccgcgagcaattaacggcccggatttcctgagaccggggtttactcccggggaaatgggggaaaagataagaatgaacaattgggggcagacgcatgaataaacaatggactattatattcgctttactatttactttgattgtcgccatctttgctgtcattaacgtgcgggcggttgaggttgattatctgttcggaaccgctgaatggccgctgattttagtcattttaggctctgtgttaatgggagcgctgatcgtgttttcagccggtatctttcaagtgatgaagctgaagcgccaaattaaaatgctgcggaaagaaaacagatccgcaggtgaattgacggctgattcggacggccaaaaaacagccgcgccgccggaagaaatgcttgaagagaaaaaaggatcagaataacatttgaaacccctcagtccgctctagtataatagggtggttgaggggtgaatttatgttagcgtcaaaaatgcgctgggaaatccagcagccggatcaggaaaaagtcaaatcactcacagaacaattggacataacacctcttgtggcatcactgcttgtaaaaagaggttttgatactgccgaaagcgcaaggctgtttttacatacaaaggatgcagacttttatgacccgtatgaattaaagggaatgcgggaagcagttgatcggataaaactggcggtttctcaaggggaaccgattatgatttacggagattacgatgcagacggcgttacaagcacgtcagtgatgctgacggcactcagacagctgtcggcggacgttgacttttatattcccgaccgtttcacagaaggctacggcccgaatgaacaagcttttcgctccataaaagagcggggattttcgctgatcattacagtggatacgggaatcgccgccgtccatgaagctgaagtcgcaaaagagctgggcttagacgtcattattaccgaccaccatgagccgggacccgagcttcctgacgtatttgcgatcatccacccgaagcagccgggatgcggctatccgtttaaagaattggccggcgtcggtgtggcgtttaagcttgcccacgcgcttacgggttctttgccggaagctatgctggacttggcggcaatcggtacggttgcagatctggtgcctcttcatgatgaaaacagattaattgcgtcactcggaatcgaaaggcttcggacgacaaatcggccgggcctcaaagccctgattaagctttccggcggagatatcggacaagctgatgaggaaacgatcggatttcaggtcgcgccgaggctcaatgcagtcggaagaatagaacaggccgatcccgccgtccatctgctgatgaccgaagatcagtttgaagcggaggaactggcttcggatattgaccggctgaataaagagcggcagaaaatggtgaaaaccatgaccgaagaggctgttgaaatggttcagcagcaaggcggaaacccgtctgccattgtagtggcaaaagccggctggaatccgggagtcgtcggtattgtcgcatcgaagctggctgaacgtttttaccgtcccgctgttgtgcttgggatagatgaggagcagggaatcgctaaagggtcggcgcgaagcatcagaggcttcaacctgtttacgagcctttcacagtgcagagacattcttcctcatttcggcgggcatccgatggcggcaggaatgacgttgaaggctgaagatgtggcggaattaagggacaggctgaatcaaatggctaaagaaacccttacggaagaggattttattcccgttcaggaggttgatcttgtgtgcggcgttgaagacataaccgttgaaagcattacagaattaaatatgctgtcgccgttcggcatgcttaaccctaaaccgcatgtgatggtgaaaaatgccgtacttgatgatgtgcgcctgatcggagcgaataaaaaccacgtgaaaatgacggtgaaaagtgattccgccgtccttgactgcgtcggctttaacaaaggagagcttgaagccggaattgtccccggatcaacgatttccattgtcggcgagatgtccattaatgaatggaacaacagaaagaagccccagctgatgattaaagacgctgcggtgccggaatggcagctttttgatatcaggggcaagcggacgtgggaagacacggtcaccgcgctgccgaaggaaaaacgggtgctcatcagctttaacgaaaaaaccgctcagaagctccgtgcaaaagagctgtcaggcgagctggccgggatcacatcggaatccgaggcggaagctctccagcttgacggaaaatatgccgtttttctggatgtgccgccgtcagcggatcgcctgcagcatttgcttgacggaaagaagccggaacggatttattttgtttttatcaatcatgaagaacatttcctgtcctcatttccatcgcggaatgatttcaagtggttttacgcatttctcttgaaaaggggcgcttttgacttcggcaagcatggttcagagcttgcgagacacagaggatggtcaattgacacaatcaatttcatgacaaaggtgttttttgatctcggttttgttaaaatagaagatggtgtgctgtctgtcgtgagcggcgcgaaaaaacgcgacctggcagattcgcaaacctatcaggtaaaacagcagctgatggaattagaccagaagctcaattattccgcagcccatgagctgaaggaatggctgaataagctgatgaaccaaggttcagaagcttatgaaagtacgaggaggacatagaacagatggatcttaaaaaatacgtaacaattgtgcccgattacccgaaagaaggcgtacaatttaaagatattacgacattgatggacaaaggcgacgtatatcgttacgccactgaccaaattgttgaatatgcaaaagaaaaagaaattgatttagttgtcgggcctgaagcgcgcggctttattatcggctgtccggttgcatacgctctcggagtgggctttgcgccggttcggaaagaaggaaaacttccgcgtgaggtcattaaagtcgattacggtttggagtacggaaaagacgtactgacgattcataaagatgcgattctgccgggacagcgcgtgctgattactgatgacttgcttgcaacaggcggcacgatcgaagcaacgattaagctggtcgaagaactgggcggcgtcgtagccggtattgcgttcttaatcgagctgtcttaccttgacggcagagacaagcttgacgattacgatattttaacattaatgaaatattaaccgcatatggaaaaaagcactcgtgtcagggtgcttttttcctattatttcatcatcctgacagattctttaggtgttttgaacttctgccctttacatctctcgtttttttcttgataataaactaatacagtttacatttaaaaaaggtgattccatggcgaacgaacaagtattgactgccgagcaagtaatagataaagcgcgcacttatctgccggaggagcagattgcgtttgttgagaaagcttacctgtatgcgcaaaacgcgcatcgcgaacagtaccgcaaatcaggtgagccgtacatcattcatccgattcaggtggcgggcattctcgtcgatctggaaatggacccttccacaattgcgggcggatttctgcatgacgtggtagaggacacggatgtcaccctcgacgacctgaaggaagcattttctgaagaagtggcgatgcttgtcgacggcgtgacgaagctcggtaaaattaagtataaatctcaagaggagcagcaggcggaaaaccatcgaaaaatgtttgtcgctatggctcaggatatcagagtcatattgatcaagctggcggatcgccttcacaatatgcggacgttaaagcatcttccgcaggaaaagcagcggagaatttcaaatgagacgctggaaattttcgctccgctggcccatcggctcgggatttctaaaatcaaatgggagctggaagacaccgctctccgttatttgaatcctcagcaatattacagaatcgtcaacctcatgaagaaaaagcgcgcggaacgcgaactttatgtcgaagaggttgtcaatgaagtgaaaaaacgcgtcgaagaagtgaatatcaaagcggacttttcaggacgtccgaagcacatctacagcatttaccgcaagatggcgctgcaaaataaacagttcaatgaaatatatgatctgctcgccgtccgtattcttgtcggaagcattaaagactgctacgccgtcctcggcattattcatacgtgctggaagccgatgccgggcagattcaaagattatattgcgatgcctaagccgaatatgtatcagtccctgcatacgaccgtaatcgggcctaaaggcgatccgctggaagtgcagatcagaacatttgagatgcatgagatcgctgaatacggggtggccgcacactgggcatataaagaaggcaaggctgcaaacgaagaagcgacatttgagaaaaaactgtcctggttccgtgaaattctggaattccaaaacgagtctaccgatgcggaagaatttatggaatcgctgaaaatcgatctgttttctgacatggtatacgtatttacgccaaaaggcgatgtcattgaactgccgtcaggctctgtgccgattgatttttcctacaggatccactcggagatcggcaacaaaacaatcggggcgaaagtgaacggaaaaatggtgacgcttgaccataagctccggacgggcgacatcgtcgagattctgacgtccaagcattcatacggtccgagtcaagactgggtcaaactggcgcagacgtcccaggcgaaacacaaaatccgccaattctttaagaaacagcgccgtgaagaaaacgtcgaaaaaggccgtgagcttgtcgagaaagaaattaaaaatcttgattttgaagtgaaagatgttttaacactcgaaaatcttcaaaaagttgccgacaagttcaatttctcaaatgaagaggatatgtacgcggcggtcgggtataacggcattaccgctcttcaggtggccaacaggctcaccgaaaaagaacggaagctgcgtgaccaggaagagcaggaaaaaatcgttcaggaagtcacttccgagccgaaacattatccgcaagggagaaaacgggaagcgggtgtgcgcgtaaaaggcattgacaaccttctcgtccgcttgtcgaaatgctgcaacccggtgcctggcgaccatattgtcggttttattacaaaagggcgcggtgtatccgttcaccgggatgactgtccgaacgtcaaaacgaatgaagcgcaggaacgtctgatccccgttgaatgggagcatgaatcacaggttcaaagacgcaaagaatataacgttgagattgagattttgggatatgaccgtctcggacttttaaatgaggtgctccaagccgtaaatgaaacgaaaaccaacatctcctctgtctccggcaaatccgaccgcaataaagtcgctacgattcatatggcgatttttattcaaaacatcaatcatctgcataaagtggtcgagcggattaagcagatcagagacatctattcagtccgccgggtaatgaactaaaaggagcgcttgctatgaaattagttgttcagcgtgtaacagaagcgagtgtgacggttgacggcgctgttgccggccggatcggacccggcattatggcgcttgtcggcatcactcatgaagatacagaagaagatgccgcttacttggcggataaaatcgtgaatcttcggatttttgatgatgaaagcggcaagatgaatttatcgcttttggatacgggcggggagattttatccgtttcacagtttacgctttacggcgaaacgaagaaagggagacgcccgaattttatgaatgcggctaaaccggatcaggctgtgctcctttatgaaaagtggaacgaactccttcgggaaaaaggagtcaaagtggaaaccggaatattcggagccatgatggatgttcagctgacgaattccgggccgattacattgattatggattctaaacaataaaaaagctgccgttcggcagcttttttttatgattgaaaataatgttccaatccgctttcaattccgtctgtcactttttcctgatacgagccgctatgtatgattgtttcttcttgcggttgactgagatagccgagctcatacagcatggcaggccgtttattttccctcaggacgtaataatcgccaaacagaacgccgcgatccgggataggggaacgcttcactacttcagaatggacgtctgaggcaagctggcgatccttagacggactgtaataataagccgtgcttccccgtgttgacgtatcggcatagctgtcatagtgaatgctgataaaggcatccgcattccggtaatgagaggttgaaaccctagcctgcaggctgataaaagtatcatcctgtctggtgatatacacgtttgcaccggccgcccgcaatttttgggccagcagcttagcggttttaatggttacgtttttctcaaactttccggagtagccgatcgttccgctgtcttttcctccgtgtccgggatcaacgacgatcgttttgtttttaagtgagccgctgccgcctgacgtgtcgggagaaggtgcttcacctgtttcctcaccgctttttgacgtttgtacgacccagtttgccacatatgcggtttgtccgttttcaagccggacttcataccatttgccgcttgagccgacaatcgggtaggctgcgcctttatctgctctttttacgatagaagcggaagtcgaggccgagctccttaagttggtgccgccgtaaacaatatacgcttttttcgaggagcctgagcccgcagaaccgtcccccgagccggatgcgctgtccgatgagtcagaatcctttatgatgtagtggcttgctgcccagcctttttgcccgtttgcttcaattttcagccagccgtggtcttcacttaagatggaaacctttgttccgcgtgataatttagtcataatcgctgaatcatgtgacgctgcacttctgacattcaatgaagaaacgccgacagtcccgttttttgacccgcttcgggcggaagtggctttcgtatccgatccgccgctgtccgcggtgacgtattcggaagaaacccatccggttgtgccttgataagaaatgttcacccatccgctgttcttgtccagcacggatgcatgtgcgccttgcggaagtttgccgatgacttcatatgatgtccccgggccttttctgatgcggaggtcaggatcggtggaagtgaccgttccgcttgttgcggatgaatggtctgctcctccggctgtttttgatatcagccaggaaacgacccatccggttttaccggggctcagctgaagctgcacccagtctccctcttctttagcgatcgggtatctttcccctttttttacttcagccttaattccatagctcaggccgggaccgcctctgacattgatcttgtctgtcgcgatgaccgcttctccctctgcggcgattgcggtgtggaatgacggaagaagcgctgtgatgatgacgccgcataaaataagagcaagagttctcttcttcatggctgtcctcctttctgaactaactaaaatacattcttgtataatatcgtattttccttgctgaatgttaaataaaaataaaatggtttgtttatactagtcataaatacagcgaaaaggtgtgcaaatcatgaaatatcaaccaaaaatgggacgcgcgctgcacgatgcggaaggaaatctgcacttcagtgatcagagcgatagagaaaaggcgggttttcttgaagagacggcgacggagttcggtcttttatcgaaagatgcggtcgcaaggaaaaacagacggaataaaacttgacaggggagtgcaatcccattattataatagaaattgatgtacataagtcatgataacgattttgaaccgataatggagaagagtaggtcagaatgcatggagaagagaggaaccgtcccgggctgaaagcggatccgcactgcatctttctcgaaacaacactccggaggttccctgctgaacgcttttgcaagtcattaggcagcggacgtgaacctgcgttaaaggtcagagcggggatgcttcggcattccaactagggtggcaccacgggtataactctcgtccctactatacatgtatagtaggagcgggagtttttttatttgaagaaagacattaaggaggcctgtaacatggcatatcacattccaagaggcacacaggacatactgccgggtgaatcagacagatggcagttcgtcgaacaaattatgagggagacgtgccgcacttatcaatataaagaaatccgcacgccgatcttcgaacatacggaattgttcgcaagaggcgtcggtgagtctacagatatcgtgcagaaagaaatgtacacgtttgaagaccgtaaagggagaagcctgacgcttcggccggaaggaacggccgccgcagtccgcgcgttcaatgaaaataaattatttgcgaacccggtgcagccgacgaagctttattatgtcggaccgatgttccgttacgaacgtccgcagacggggcgtttccgccaattctatcaattcggaattgaagcgatcggctccaaagatccggccgtggatgcagaagtcattgcgcttgcgatgagtatttaccgtaaagccggtttgaaacatgtcaagcttgtgctgaacagccttggtgaccaggagagccgcaaatcctaccgggaagcgctcgtcaaacattttgaaccgcgcatcgcagagttttgctcagactgccagtcgcgcctgcacacaaacccgctcagaattcttgactgcaagaaagacagagagcatgaactgatgaaaacggctccgtccattcttgattacttaaatgaagaatcagccgcttattttgagaaagtaaaacaatacttaaacgatctcggcatcccgttcgaaatagatccgaaccttgtcagagggcttgattattataaccataccgcttttgaaattatgagcaatgccgaaggattcggagcgattacaacccttgccggcgggggccgctatgacgggcttgttgaacagatcggcggacctgaagcgccgggtatcggatttgcgatgagcatcgaacgtctgctggcagccattgacgctgagaaaacagagcttcccgtcaatcaggggattgactgctacatcgtgacgctcggagaaaaagcgaaggattattccgtttccctcgtgtacaaactgagagaagcgggcatctcaagtgaaatcgattatgaaaataaaaagatgaagggccaatttaaaacagctgaccgtctcggcgcacgttttattgcgattttaggggaagatgagcttgcccaaaataaaatcaatgtaaaagatgcggaaacaggagagcagcgtgaagtggtgttagacgagctgatacaagtgttaaaggcagatcaaaagcagtgaaggagaggaacgctatgtttggaagaacatattattgtggcgagataactgaaaaagcgattggcgaaaccgtcaaactgaaagggtgggtgcagaagcggcgcgatctcggcggcttgattttcattgatttgcgcgaccgctcgggtattgtgcaagtcgtgttcaaccctgacgtatcgaaggaagcccttgccgcagcggaagcaatcagaaacgaatatgtgcttgatatcgaaggcacggtttctgcccgtgaagaaggcacggtgaatcccaacctgaaaaccggtaaaattgaaatcaaagctgaagcggtgacggtgctcagtacggcgaaaacgcctccgtttccgatcagtgaccaggcggctgaggtttctgaagacgtccggttaaaacaccgctatttggatttgcgccgcccggcgatgtttcaaacattgcaaatgcgccaccaagtcacaaaatccatccgccatttcttggatgaaaacggatttcttgatattgaaacaccgattttaacaaaaagctctcccgaaggcgcccgtgattacttagtgccgagccgggtgcatgaaggggaattttacgcccttccgcaatcgccgcagatttttaaacagcttctgatggtgtcgggctttgaacggtattatcaagtggcccgctgcttccgcgatgaagacttgcgtgccgaccgccagccggaatttacgcagattgatatcgaaatgtcctttatgagtcaagaggacatcatggctctggcggaagagatgatggcgaaagtcatgcttgaaacaaaaggtgttgaagtaccgcttccgcttccgcgaatgacatatgaagaagcgatgaacagctacggttccgacaagcctgacacccgcttcggcatgctgctgacggacgtgtcagacatagtgaaagatactgaatttaaggtgttctcatcagccgtggcaaacggcggcgttgtaaaagcgatcaatgtcaaaggcgctgccggcgactattccagaaaagatatcgatgcgctcggcgtttttgccggaaattacggcgcgaaaggtctcgcctgggtgaaagttgaagccgacggcgtaaaaggcccgattgcgaaattctttgatgaagagaagcaggcaaaactggctgaagcgcttgatgcttctgaaggcgatctgctcctgttcggcgctgataagtttgaggttgtggcccaatccctcggcgcgcttcgcttaaagctcggcaaagaacgcggcctgattgacgaaagcctcttcaacttcctgtgggttgtggactggccgttactggagcatgacgaggaggaaggccgtttctatgcggctcaccatccgtttacaatgcctgtccgtgaagatcttgacctgattgaaacggcgcctgaagatatgaaagcgcaggcttacgaccttgtcttaaacggctatgaactcggcggaggctcaatccgtatttttgaaaaagacgttcaggaaaaaatgttcgggcttctcggctttacaaaagaagaagcggaggaggagttcggataccttcttgaagcctttgaatacggcgcccctccgcacggcggaatcgcgctcggcttagaccggttggttatgcttcttgcaggccgcacaaacttaagagatacgatcgctttcccgaaaacggcaagcgcaagctgccttcttacggaagcgcccggcgaagtgagcgacgcccagcttgaagaacttcacctttctgtcaaaagaaaagtgaaacagtaaagatcagcagtttgtttcttgaaaatcaaaatctgctgtgatatgattttgacaagttaaataaagtcctgatgtgttagttgtacacctagttttgaccgaacatttttttgatttgggagcccgtatttttaaatggcgtacatgcctcttttcattcgttaagaggacttacaagatttaaaaaagggcacccacctgctgagagcgggttcaaaacgaaggaaagctgcaacggcacaattgggactttattttttgtgcgctaaaaccagcggctttttgacaagccgagtttataaaaccagaatgtggagtgaggttcttgttacatcagttttccagaaatgagctagcgattggaaaagaagggctggacacgttaaaaaacagcacggtggccgttctcggcgtcggcggagtcggttcattcgcagccgaagcattggcgaggtccggagtggggcggatcgtgcttgtcgataaagatgatgttgacattacaaacgtaaaccgccagctgcatgcgctcttgtcgacggtgggacagccgaaaacagacttgatgaaagcgcggatcgcggatattaatccggattgcgatgtcgtcgccttaaaaatgttttatacggaagagacgtatgagcagttctttgagcatccgctcgattacgtcattgacgcgtcggatacgattcattataaaattcatctgatgaaagaatgtctgaaacggaatgttccgctgatttcaagcatgggagcggcgaataaaacagacccgacacgctttcagattgctgatatttcaaaaacccataccgatccgattgccaaagtcgtccgcacaaggcttcgcaaagagggcattaaaaaaggcgtacaggtcattttttctgatgaaagcccgatcgtcatccgtgaagacgtcagaaaagaagtcgggaatgatgaagcgaaaatccgcaaagcgcaaatgccgccgtcttccaacgcctgggttccgtcagtggccggtctgattatgggcggacatgttgttatggagctcttaaaggacatcgacattaaacgggttaaagataaataaaaagaaaaacagccttcttcaggaaaggctgtttttttatttgaatccgccgtttacacgaaagattttggccggtatcaaaaaagacaagaacacatagggtgtccttgtccggttattttttctgcttcatcagtttttcatacacttgctttatggcggcttcaaatttccccgtttgtttcggtttatagtattgcttgttttttaacggatcaggtaaatattgctgttcgacccatccgttctcgaaatcatgaggatattgatatccgatcccgcgtccgagctcttgggcccctttatagtgggcgtcttttaaatgtttcggcacatcgccgattttacccgtcctgatgtctttgagcgcctcatcaacggctgagatggcggagtttgattttggcgagaggcataattcgattaccgcattggccagcggaattctcgcttccggaaagccgatccgttctgcggtctgaatcgcgctcagcacccgggggcctgcctgcgggcttgcgaggccgatatcttcataggcgatcacgagaagccttcttgatatgctttcaaggtcgccggcttcgatcagacgggccagataatgaagggcggcgtttgcgtccgagcctcggatcgatttttggaaggcagataagacgtcataatgcgcatcgccgtttttatcatgagtatagctttttttctgcagacattcttccgccgtctcccgtgtaatccggatcgtgccgtcgcttgattcctttgtggagagtacggcaagctcaagtgcgttcaaagcggagcggacgtctcctccgcacccttgcgcgaaatgatccatcgcgtcgtcgtccaccgaaacgctgtaggaaccgagcccccggtgttcatctgtgagcgctctttccaatgcctgcttgatcagatcgggtgttaacggttcaagctcaaatatctgggtccggcttctgatggccgggttaatggcatgataagggttggcggtcgtcgcgccgattaaaataatcatgccgttttctaaatagggcagcagaaaatcctgctttcccttatcaagcctgtgcacttcgtcaaggattaaaatgacctggcctgacattttcgcttcctgtacgacaatctccatgtcttttttattatgaatgacggcattcaatttcctgaatgcgatgcttgtcgatcctgcgatcgctgtggcgatggacgtttttccgatgcccggcggtccgtacaggatcatggatgataagtgctttgcacgcaccattctgccgatgattttatcttctttgaccaaatgttcctggccgataatgtcttcgatattggcaggccgcatccgatacgccaatggtttcatgaacatctctccttacatatacagggtaacggaaaacggacgattagaaaagcgaattgcggcgggccccgtgtttcaatgaaaattaggataagttatgttataataacagttggtctataagatactaaacagattattcatatccatttacttgtataaattaacaattagaattgactggggtgttcatattgaaaatatcgacaaagggaagatacgggctcaccattatgattgaattggcgaaaaagcacggagacggtccgacgtcgctcaaaagcatcgcccaaacaaacagcctttctgagcattacttggaacagcttgtatcaccgctgagaaacgccggactcgtaaaaagcatcagaggcgcttacgggggttacgtgctcgggggccagcctgaagagataacggccggagatattatcagagtgctggaagggccgatcagcccggtagaagtgcttgaggatgaagagcctgccaagcgggagttatggatccgcatccgcgacgctgtaaaagacgtgctggacagcacgacgttagaagaccttgcgagctacacggacggcgagcaggaagcttatatgttctatatttaaaccagaggtgtacagacaatggaacggatttatttagatcacgccgcgacttccccgatggatgagcgtgtgctcgaagagatgaagccccatttcttcggcagtttcggcaacccgtcaagcattcattcattcgggagagaatcccggaaatgggtcgatgaagcgagaacggacatcgcgcgcgaaatcagtgcgaaagaacaggaaattattttcacaagcggcggcacggaggctgataatttagcgattttcggaacggctgccgcccggaagaatgaaggaaagcatatcattacgaccgctattgagcatcatgctgtattgcacgcctgcgaaaagctggaagaagacggctttgaggtgacatacctcatccccggcccttcaggacggatcagtgcaaatcaggtgaaagaagcgctccgtgatgatacaatccttgttaccgtcatgtatggcaataacgaagtcggtaccattcagccgattgacgaaatcggagagctgttaagcgggcatcaggcctattttcacacagatgccgtccaggcattcggttatatgccgattgacgtgaaaaaaagcagaattgacatgctgtctgtttccggtcacaagcttaacgggcctaaagggacaggctttttatatgtaaatcaagaggtgaagctgtcaccgattcttctagggggagagcaggaacgaaagcgccgcgcggggacggaaaatgtaccgggcatcgccggcttaaaagaagcggtcgtcctttcaaaccgtgagagggaagagaaaacagcgaagtataaggagtttaagaacattatcatgagcacgctggaaaaatccggcgtcacagcggaggtgaacggagatgccgagaaatgcctgcctcatattttaaacctttactttcccggtgtgccggtggaagcgctgctggtcaatcttgacatggaaggcattgccgtctccagcggatctgcttgtacggcaggatccgttcttccgtcccatgtgcttacggccatgttcggaagtgagagcggcaggctgacttcgtcaatccgcctcagcttcggcctcggcaatacggcggaacaaatcgaaacagccgccgaaaagcttgccgccgtcgttaaacggcttgcttaaaacggcggacttacgtttttaatggagtgaatgcaaatggaaaaacggccggaggatacaagagtcgtagtcggcatgtccggcggcgtggactcttccgtggcggcccttctgctgaaggagcagggctacgatgtaatcggaatctttatgaaaaactgggatgatacggacgaaaacggtttttgcacggcgacggaagattatgaagacgtcatccgggtctgcaaccagatcggaattccgtattatgccgtcaattttgagaagcaatattgggaaaaggtatttcaatatttccttgatgaatataaagccggaagaacccccaatccggatgtcatgtgcaataaagaaattaagtttaaggctttcttggatcatgctctgtcactcggcgcggattatcttgcgacgggccattacgcccgcgtggacagaagcgcaggtacagtgcgcatgctccgcggtctggatgaaaacaaggaccagacttattttctgaatcagctcaatcaggaacagctcagcaaagtcatgttcccgatcggtgatctgcaaaaaagccgcgtgcgggaaatcgccaaagaagcggaacttgcgacagctgcgaaaaaagacagcacgggaatctgctttatcggcgaacgcaacttcaaaacgtttctcagccaatatctccccgctcagccgggcgatatgatgacaatggacggagaagtaaaagggcgtcatgacggtctgatgtattatacaatcggacagcgccacggtcttggaatcggcggaagcggcgagccgtggttcgccgtcggtaaagatcttgaaaaaaacattctgtatgttgatcaaggattccataatccgcttctgtattctgataagatcacggcgacaaatgtcagctggacgcgtcccggtctgatggacggcggcgaaatgacatgcacggcgaaattccgctaccgtcaggaagatcacaaagtaacggtgaaaatgacgggtgatgatgaagcggaagtcatttttgacgggcaggtacgcgccgttacgccgggacaagccgtcgttttttatgacggagaagagtgcctcggcggcggaacgatagatgacgtttataaagacggaacaaaactgtggtacgtataataacatgtaaaaaacctcaactcgcatgttggggttttttagcgaaaggaagttaaaaatggattataataaaatcgggattgacgccatgcaggagggcgattttgaaaaagcggcggaggcttttacgaaagcgattgaggaaaacgggcaagatccggtgccgtatatcaacttcgcaaatctgctttcttctgtgaacgaactcgaacgggcgcttgcattctataacagagcgctcgaattggacaattcggcggcagccgcttattacggtgcgggaaacgtatatgtgatgaaagaatcgttttccgaagcgaaggatatgtttgaaaaagcgcttcgctccggaatggaaaacggagatttgttttatatgctggggaccgttctcgttaaattagagcagccgaagcttgcactgccatatttgcagcgtgccgttgaattaaatgaaaatgacacggaagcacgcttccagttcggaatgtgcctcgcaaacgaagaaatgctggatgaagctctggcgcagtttgagacggtgatcgagcaggacccaagccacgcggacgcattttataatgccggggtcgcttacgcgtacaaagaaaatcgtgaaaaggcgcttgagatgctggaaggcgcaatcggcatacagcctgatcatatgcttgcgcttcatgcgaaacagcttatcacccagtcataacaaaaggagggaaggctcgtggatcagctgaacatcgaagaacagccgtatgtaaaaggcgtcattcatacggtcatttatcacaatgacaccaacctgtatacagtgctgaaagtcaaggttgcagaaacgtctgaggcgatcgaagacaaggtcgtatccgtaacgggctacttccctctgctgcaagaagatgagacctacacattttacggaaaaaccgccacgcatcctaagttcggcctgcaatttcaggctgagcactttaaaaaagaaattccgaccacaaaagaagggatcattcactatttatcaagtgatctgtttgaaggaatcggaaaaaaaacggcggaagaaatcgtcaaaaagctcggagacggcgcgctcaataaaattctgacggatgcgtcggtgctttacgatgtgccgaaaatgtcgaaaaagaaagcggataagcttgccggagagctgcagcggcatcaggggcttgagcagattatgatctctctgaaccaatacggtttcgggccccagctatccatgaaaatatatcaggcctacgaaacggaaacactggagaaaattcaggaaaatccttatcagcttgtaaaagacgttgaaggcatcggctttgtgaaagctgacgagctgggcggaaaaatgggtctgtcaggaaaccacccggagcggatcaaagcggctatcttatatacaattgaatcgacctgtctttcagagggccatacgtacatagaaacaaagcagctgataatcaatacgcaaacgctcctgaatcagtcagctgaaggcggcctcgtcacggaaatggatgcggctgacggcatcatcgccctcggagagagtaaggatatcgtcatagaaggagaacgctgctattttccgtccttgttttacgccgaacaaaatgtcgcaaaacgcgtgctcgacattgcggctcagacggagtatgccgatcaatttcctgaatcggaatttctgcttgcactcggtgaactggaagaacggatgaatgttcaatacgcaccaagccaaaaggatgccattcaaaaagcgctgtcttcaccgatgcttttactgaccggaggacccgggacggggaaaacgaccgttattaaaggaatcgtggaattatacagtgaactgcacggagtatcgcttgaccccggtgattataaaaaagacgaggcgttcccggtgctgcttgccgcgccgacgggaagagccgcaaaacggatgagcgaatctacgggtctgccggctgttacgatacacaggctgctcggctggaatggcgctgaaggctttacctacaatgaagatcagccgatagaagggaaactgatcattatagacgaagcgagtatgctcgatatctggctcgccagccatttgtttaaggcgcttcctaagcacattcagctcattgtcgtcggtgatgaagaccagcttccttcagtaggaccggggcaggtgctcagagaccttttggcttctgaggtgctgccgaccgtgcgcctgacagatatttaccgtcaggctgaaggatcatccattgtggaacttgcgcatgatatgaaaaaaggactgcttccaaaggggctgaccgcgccgacaaaggaccgctcatttatccgctgtaattcttcacagattaaagaagtcgtggatcaggtcgtctcgaacgcgttaaaaaaggggtatacctccagggatattcaagtgcttgccccgatgtacaggggaaaagcgggaattaacgagctgaatatgcttcttcaagacatcatgaatccgccgaaagaaaaaaggcgggagctgaaattcggagatgtcgtctacaggacgggcgataaaatattgcagcttgtcaaccagccggaaaacaatgtgtttaacggcgatatcggcgaaatcgtatccattttttatgccaaagaaaatacggaaaaagaagacatggtcgtcgtctcatttgacggcaacgaaatcacctttacgaaaaaggatttcagccagtttacccacgcgtactgctgttcgattcataagtcgcagggaagcgaattcccgattgtcgtcctgcctgtcgtcaaaggctactatcgaatgctcaggagaaatctgctttataccgccattacaagggcgaaaaaatttctgattctttgcggagaagaagaagcgcttgaatggggcgtcaaaaacaatgatgccaccgtcagacagacatcgcttaaaaacaggctcacagagcagactgaagagatggatgcagaactggccgccctgcaaaaagagctgccgttcagtgtatatgatgcgaacatcggaatggaaggcatcacgccgtttgactttatggaagaaaaagcgtaaataaaacccggagcataaacaagcgccgggttttcgcctgtggaagtcatttcaaagtatgctgcccggcttcttggcaaaacctatacgtgttcaacaaaaggtggttgatcacactttgagaacatgccatgcagctgaaggacgaacagtatatgacgaaaacaccgggcgcagtctcgggatgatatcggatgtatgtttctctctggacggccggtttctcggtttcgtgctggagcagaaacgcctgtttcataaccgccatctttttttagaggcaagtgatataaaagagatggatcaagaagccgtagctgccggtcatgctcatttgcagcctttgccgaagagctgtttcacctttgaacagattaagatgcagccggtgaaatcgcctgatggtgaaatgttcggtttgctggaagatgtatacttttgtttggacaggggcataatcgtagcatatgaactctcggacggcttcttttcagatctggctggcagacgccaagtgcgccgcgccgccgatacgcttattgaagcggggaaagaaggcatcgtcctgaacggataagaggtgtagtctgtgcttgtatgtccgaactgcaaaagtaaagatatcggcaaaatcggcgtaaaccaatactattgctggggctgcttcattgagctgacggtagccaaaggcaaaattgcgacacatcaagtagaggaagacggcacgttaagcagtcttgatgatttgttttctgaagacgaacgcagtatcaatttttaaagttgaaaggagatacgcgcgatgggcagaacaatgacctctctgttggctttaggagctggagccgttatgtatcgtatggcttctcagtccgatatgctgaataaaaaaggtatgaaacggatgagaagacgagtcatgaaaatgttttaagcagaaaaaaggatacttctccggaagtatcctttttacgtttgtctcgcttccagccgtctggctgcgagagacaggctgtaattgaccgcgaaatacatcagggccgccagcagaaagatcgggaaaaagtaccctccgtcagcgctttgtccgtttaaaatctgcgcgttatgaatcagttcgggcagagcgatgacgaccgcaagtgacgtatcctttaataaagaaataaactggctcacaatcggaggaaccatacgcctgagcgcctgcggcatgacgacgagaaaaagagtctgcgtgtacgtcagtcctgaagaacgcgccgcttcaatctgccctttgtcaacggattgcaaaccgcttctgatgatttctgacagcatggccgattcaaaaatcgtaagcgccgtgatggcagccgcggtaatttccagtttgatcccgatttccggaagggcaaaaaacgtaaagaaaatgattaataacagcggcaggttgcggatggtttccacaatggccgctataatgcccgagacgataggaattttcgcatagcgcaaagtgccggcggcaagcccgaaaataaaactcaggacaatggagatcagcgcaacataaagtgtgaccaaaaagccgtcccataaaaacagcagatggtcaggtgtataggcgccgctaaaatccatgtttttcactctccttctctaataactctttccgagacgtctttccaaatagtgaaccccgatgctgagcgggatcgttactatcaaataaaaaagcgcgacgaaaatatagacatcaaacacgacaagagtgcttgaggaaacgagatccgcctgatacatcaaatcgagtcccgccaccactccgagtattgatgagtttttgacaaggttgagaaattggtttccgagcgggggaatcacgatttttacggcctgaggaagaatgacgtatctcatcgcctgactgtaggtgaagcctgacgatctggccgcttccatctgccctttggagacagtctgaattccggctctgatggcttctgcgataaaggccgacgtgtatatcgtcagcgcaatcgttcccgcctgaaagccgtccagtctcagcccggcgttcggaagtccgaaataaaaaacgaatgtgatgaggagaagcgggatgttgcggataaattccacatacgcagtgccgatccattgaaggggtttgaaagccgtgattctcatgactgcgatcagaacgcccagcgcaaagctgcctgccagcgcgatgaagctcgcaagcaatgtgtgcaggaaaccgtccatatacatatcgaagttttccgttaaaattgaaaagttcatctatgtcactccttataaaacggggatgagcatgcctgctcatcccgcgatcctttctattttgccggttcttctttaatccattttttatagattttttcgtacctgccgtcggctttcatttttttcaaagaggcgttgatttccttgatgagtccggattggccttttttgacggcgattccgtaaggttcatcggtgaaggtttcgcctgtcagctgatattgtttattttcatctgccatgccgtataaaatcgcattatcagttgtgagcgcatctccctgtcccgctttaagcgcagtgaacgcttcggcgtaattttcaaattccagcactgaggcgtcaggcgctttttctctgatgttttgtgaggaagtagagccttttaccgccaatacttttgagccttttcccaggtcttcggtgcttttgatgctgcttccttttttgacgagcagggattgcccggcttcaaaataaacatctgagaaatcaacttcttttttccgctcatccgttatcgtcatcgtggcggtgatagcatcgatatcgccgttttgcagcatcggaattctcgtttttgacgtcacttctttaaattccgctttcttctcatcccccagaatatcttttgcgagctgttttgagatatcaatatcgaagccttcaatatcaccggagcttgggtttttcagcccgaataacctcgtgtcggttttgacgccgaagatgattttgtctctgtctttaatagaggctaacgtgtcttttcccgttccttttgaatctccggacgtttctttccctccgcaggcggccagcataaagacggccagcagtgatatcaacccgaatgacaaccattttgttacacgtgacataagcactcctccgtttcttttcagtgatttaaaatacggcttaagaataaacgcgccctctcttcacgtgggctttcgtaaaattcagccggtgcagcttcttctaagatggctccgccgtcgataaacacgatgcggtccgccacttcttttgcgaatcccatttcatgtgtgacgactgccatggtcatgccttcctttgcgagtgttttcatgacatccagcacttccccgatcatttccggatcaagcgcggatgtgggttcatcaaacagcataatttcgggcttcatcgcaagccccctggcgatggcgacacgctgctgctggccgccggaaagctgtgaaggataagcgtccgctttttccggtataccgacttttttcaaatagtataaggccgtttcttttgcttcttcttttgattgcttaagcactttgatcggtgcgagcatgatgttttgcagaacggttttgtgcgggtacagatgaaaatgctggaacaccatgccgatattgcggcggaccttatttatatccgttttcttgtcatggatggagacgccgtttaccgttaaggcgcctccatcaactgtttccagctgattaatgcagcggagaagcgtgctttttcccgatcctgaaggtccgatgataacgacgacttccccttttttaatgtgcagattaatgtttttcagcacgtggaaatgtccgtagtgcttatttacatcctgaaatgaaatcatggccatcctccttaaaaaaacatgagtcatattgactggacagtttttgaaatcctttaacacattacgatggttatacagatttttatgaatattatttagattatttcgtaatttctgataattttttccgtcaagaggtctgcgtcataaggcggagtttatgaaacgggaataattccggctttctgtcaaaagataaagcaagaggtgaaacgtcatgcttcaaaaaccgctgcagctcttaatgtggacggctgtatgtctgctcgttttgttaacagtgtatgtcttttgcatgctcgatatgttatggtctcccatttggcttgttataaaatctctctttattcctatattcatcgcagtatttattgcttatcttttacttccgattactgaatggcttcatagaaaagggatgcctagaactttaagcctgcttctgatttattgcctgtttttcggcggaatcggctggggggtttataaaggggttcctgttttaattgaacagctgcaggatctgtctgagagcattcccggtcttgccaaaaactacaacagcatgctgaagcatctgcataatcacacggatcattggcctgacggcatgcaccatcgaatggacaaaatgattcagcagacagaaacgtttcttgccggcacgattgaaagcacgatcagaagcatccgtttcgtgcttgattatatcctgatcgcggcgacgattccttttctcgtgttctatatggtgaaggatatagacgtcatgaaaaagacagtctggtatttgacgccgaagtcctggagaaaaagggggagtgaatttctgcgggatgtggacgactctctcggtgattacatccgcggtcagcttctcgtttgttttttgctcgggctaatagccggcgtttcattttggctgttcgggcttccttacccgctgattttgggccttgccatcgggattacgaatgtcatcccgtatttcggtccgtttatcggcgctgtaccggcgctgctccttgcgctggcgatttctgctaaagctgtgatcatcgtaatcgtcacgatttttattctgcaatttatagaaggaaacattttgagcccgcttattgtcgggcgcagtctcagaatgcaccccgtcgtgatcatgctggcgctccttgccggaggagagctcgcgggcattcccggcatgattctcgctgttccggcggcagccgttttaaaagtgacggccatacactttttgcggatcaggacggaacattgacattcgggttctgcttgtctataatttcgagtagaatacatacgaatctcgagtgacggatatgagtacgccgaagccctgtttaagagagaagctccgatacgctgaaaggagcttcagcagaagatcggcggaagctaatcctgagtgcagttaaaggctgccgcagtcctgcgttacgggatgaaaggtgacaggcctttttcggcctgtaatcagggtggtaccgcgagacagctctcgtccctgtgtgaacgcatggtttgcatagggagagagcttttttgctgtcgcaaaagagaatttcgggtagtgataaggaggaatatagatgaaacacttaacttctgctgaagtgcgtcaaatgtttttagatttctttaaagaaaaaggccatgccgttgaaccgagcgcctcattggttccgcatgaagatccgtctttattatggatcaacagcggcgttgcgacgctgaaaaaatactttgacggccgcgttgtgccggagaatccgagaattgtaaacgcgcaaaaatcaatccgaacaaatgatattgaaaatgtggggaaaacggcgcgccaccacacgttctttgagatgctcggaaacttttccatcggtgattattttaaagaagaagcgatcacgtgggcatgggagtttttaacgagcgaaaagtggatcggctttgatccggagctgctgtctgtaacggttcaccctgaggatgaagaagcttatacgctatgggcggaaaaaatcggcgttccggaagaaagaatcatccgtctggaagggaacttctgggatatcggcgaaggcccgagcggaccgaatacggaaattttctatgaccgcggcgagaaatacggcaatgacccgtcagattctgaattgtatccgggcggcgaaaatgatcgctatcttgaagtatggaacctggtattctcagagttcaaccacaacccggacggcacgtacacaccgcttccgaagaaaaacattgatacgggcatggggcttgaacggatggtctccgtgattcaggatgtcccgacaaactttgacactgatttgtttatgccgattattgaagcaacagagcgcatttccggagatgcttacggaaaggatgcagtgaaggatacggcctttaaagtgatcgccgatcatatcagaacggtcgcatttgcggtaagcgacggggcgctgccttcgaacgaagggcgcgggtatgtactgagacgcctcttgcgccgggcagtgcgttacgcgaaaaccctcggtatcagccgtccgtttatgtacgagctagtaccgactgttgcaggaattatggacgctttctatccggaggtgaaagaaaagcaagagtttatcgccaaagtcatcaaaacggaggaagagcgcttccacgaaacattaaacgaaggtctggccattttatccgacgtgataaagaaagagaaggaaaaaggcagcggcatcatctccggaaaagacgtattcaaactgtacgatacgtacggattcccggttgaattgacggaggaatacgcggaagatgagcaaatgacggttgaccataaaggctttgaagccgaaatggaaaaacagcgtgaacgggcgagaaatgcgcgccaagatgtaggaagcatgcaggttcagggcggcgcattgcgcgatattaccgcagaaagcacatttgtcggctacagtgccgtaaaagctgaagcgaaggtgatcgagcttcttcatgacgggcaattaatcagcgaggcgcatgaaggggataccgtccaaatccttcttgacaaaacgcctttctatgctgaaagcggcggacagatcggtgacagaggagtgctgagaagcgagcaggctgtcgtaaccattaaagacgtgaaaaaagctccgaacggtcagcatgtacacgaaggcacggtggctagcggcacgattcaaaaaggcgcaagcgtgacggctgaagttgaagatcaaatgagaagcggcgtggtgaaaaaccatacggcaacccacctcctgcaccaggcgctgaaagacgttctcggcacacatgtcaaccaagcgggttcactcgttaccgaaaatcgcctgcgttttgacttctctcatttcggtcaagtgacgaaagaagaacttgaacgcattgaaggaatcgtcaacgaaaaaatctgggagagcattccggtagcgattgatttgaaaccgatcaatgaagcgaaagaaatgggcgcgatggccctgttcggcgagaaatacggcgatattgtccgcgtcgtacaagtcggagattacagccttgagctttgcggcggatgccatgtcacgaatacggctgaaatcggcctgtttaaaatcgtatccgaatcagggatcggcgcagggacgcgaagaattgaagccgtaacaggaaaaggcgcttatcaggaaatgaacagccagctcagccttctgcagcacgctgcggacgagctgaaatcaaacgtaaaagacgtaccgaagcgaattcagtctcttcaagcggagctgaaggaagcgcaaagagaaaatgaatcattgctcagcaaacttggcaatgtggaagccggagccattctgtctaaagtaaaagacatcggcggcgtaaaagtgctggctgaaaaagtaaatgcgaaagacatgaaccaccttcgcactatggtggatgatctgaaagcgaagctcggttctgcggtcatcattctcggcgccgtgcaaaatgagaaagtcaacctttcagcaggcgtgacgaaagacctgatcgaaaaaggccttcatgccggcaaaatggtcaaacaagcggctgaagtctgcggaggcggaggcggaggccgtccggacatggcgcaggccggcggaaagcagcctgaaaaattggaagaggcgctggcatctgcggaagattggataaaatccgttttataatcctttcaagtagtgtagaatgatgataagatgaggacctcaggctgaactttgcctgcgaatttgggaaagaggtgcaaaacggtgagctcgtttgataaaacgatgaaatttaatttctccgatgattctgctgaaacaaacgtcgaagaagtgctgaatacggtatatgatgcgcttcaggaaaaggggtacaatcctatcaaccagattgtcggatacttgctgtctggagatcctgcatacattcctaggcatcgcgacgcccggaacttaattcgcaaactggaacgtgacgaattaatcgaggaattggtaaaatcctatctagaacagcataaagaggcgtaaatacattcatgagaatattgggacttgatcttggaacgaaaacactcggcgtagctttaagcgatgaaatgggctggaccgctcaaggcattgagacgataaaaataaacgaggctgaaggagattacggtctggaccgtttatccgagctgatgaaagactataatgtagagaagatcgtgctcggttttccgaaaaacatgaacgggacgatcggtccgagaggcgaagccagccaaacatttgcgaaactgcttgaaacagcgtacaatgtccctgttgtgctgtgggacgagcgtctgacgacgatggcggctgaaaaaatgctgatcgcggctgacgtcagcaggcaaaaacgaaaaaaagtcattgataaaatggcggctgtcatgatccttcaaggatatctggacagtttaaactaagaggtgaaaaaaatggaacacggcgaaaaacacattacaattgtcgatgatcaaggcaacgaacagctttgcgaagtgctgttcacatttgaaaacgacacattcaacaaatcttacgtactttattatccgattgatgctcaagacgatgatgaaatcgaaattcacgcttcaagcttcgaaccgaacgaaaacggtgaagacggcgaactgatgccgattgaaaccgatgaagagtgggaaatgatcgaagaaacgctgaacacgtttttagcggaagaagacgaagaataaaatgaacggaaaaagccggagcgcatatgcgcttcggcttttttttgtaataaattgccgaatgcacatgaatcatgtagtataagagctgttgggaggaaaatacttgtatgaatatcaatcagactaaacattcatttccgcgtaaaaacaaaaaaacgacgataatactgtcctccgtgatcgctctgcttatcatcatttgcggtgcttttttctatggaaaatctctgctgtccccggttgacaaaggcagcaaaacggcagtcaatattaatattccgagcggttcttccgtttcggcaatcgctgaaattcttgaggatcagcatgtcatcaaaagcaaaaaagcatttcagctgtatgtgaagtataaaggcgcttccgggtttcaggcgggattttaccacctgaataaaggaatggatgcggatgcgattatcaaaaaactgaccgcgggatcaacgggatatgcctttcagatctccgttcctgaaggaaaacagcttacacagattgcggatgcgatcgcaaaagaaacatcatattcaaaagaagagatcatggcgaaactggatgacaaaacattcatcggcaaactgaagaaacagtttcctgatacgataacggacgcactttcaaacaagaagctcaagcatccgctcgaaggctatctgtatccggccacatatccgtttaatgatccggatgcatcgcttgacacgattttgacggcaatggttcaggaaacaaacacccgtatcgaaacgtataaatctgaactggaaaaaaagaaactttccgttcataacgctctgacgatggcatcgcttattgaagaagaagccaccgccaaagccgaccgtcacaaaatcgccagcgttttttacaacaggctcgaagaaaaaatgccgctgcagactgacccgacggtattatatgcggccggtaagcataaaagccgggtctactacaaagacctgaaaattgattctccgtttaatacgtataaacataaggggctgccgccgggaccgattgcaaatgccggtgattcatcatgggaagcggctctccgccctgacaaaacggattatctctatttccttgcaaaatcaaacggcgaggtcgttttcaccaaaacattaaaagaccataataaagcgaaggaaaagtatatttccaaaaaagacagcgaataaaaggagggcaaaagctctccttttattccattctgaaaggttttatgataaaatatatcgggttgtttacttatggataaagaagtgtcttaagagagtgtccccgcggattcgtcaggggcactcctttttagaacggaggctgtttgccgtgaatgatcggtatgaacaaataaacgagtatataaacgcgatgctgaagcctcggcctgataaagtgaaaaagcttgaagcctatgcaaaagagcaccatgttccgattatggaagaagcgggcattgaagtgctgcttcaaatgctgtcgattcaacaggcgaaaaacattttggaaatcggcgcggcaatcggatattccgccatacggatggcgcttgagcttccggatgcgaatatttacacgattgaacgggacgacaaacgctatgaagaagctgtgaacaatataaaagactttgaaatggaaaaccggattcacgtaatgcacggggatgcgctggatctttctgagtctgtccgtgtcacggctccttatgatgccatttttatcgacgcggccaaaggccagtacacgaacttttttgagctctatgaaccgatgcttgcgccggatggagtcatttttacggacaatgttctgtttaaagggctggtggcacaaaatcactcggacattgagccgaaaagaagacggaagcttgttgaaaaaattgatcaatataaccaatggctgatggaccggcctgactatcaaacggtcatactgccggtcggagacggcatcgccatcagtaaaaagaagaggtgaaggatcatgaaaaaacctgaacttttggtgactccgacttctgtacaggatattcttccgctcattcaagcgggcgcaacggccctgttggtcggagaacagagatacggcctgagactggccggtgaattttcaagagaagatataaaagaagccgtaaagacagctcatcaggaaggcgcgaaagtgtacgccgccgtcaatgctatttttcacaacgaaaaagtggacgagctgaacggctatcttgcctttttgcaggaggccggcgttgatgcggctgttttcggtgacccggccgttttaatggcggcgcgtgaagcggctcccgagcttaaactgcattggagcacggaaacaacgggaaccaactactattcctgcaattactggggacgcaaaggcgcacggcgggcagtgctggctaaggaattaaatatggacagcatcattgacataaaagaaaacgccgaagtggaaattgaaattcaaatccacggcatgacgtgcatgttccaatcgaagcgttctttagtgggccattacttcgaataccaaggtaaagtcatggacatcgaacagaagaaaaaagaagcggggatgtttctgcatgacaaggaacggggcaataaatacccgatttttgaagatgaaaacggcacgcacatcatgagcccgaacgatgtgtgcatgattgatgaattagaggacctgatggacgccggcatcgattctttcaaaatcgacggagttttgaagtctcctgaatacttaactgaagtgacccgcatgtacagagaagcaatcgatttgtgcttcgaaagccgagagacatacgaagagaaaaaagagagctggatagagcggattgaaagcattcagcctgtgaacagaagcatcgacacaggattcttctttaaagaaacggtctattaaaaaggagggtgcaacggatgacagccgtaaatcaaaccatttccaaagtcgtaaacggaaaacgcgtcattacgaaaaaacctgaactccttgctccggcaggaaaccttgaaaaattaaaaattgccgttcattacggagcggacgcggtttttatcggaggacaggaatacggactccgctcaaatgcggataacttctcaatagaagaaattgcagagggcgtagaatttgccaaaaaatacggggcaaaaatatatgtgacaacaaacattttcgcccataatgaaaatatggacggtctggaagaatacttaaaagcgttgggagacgcaaaagttgccggaattatcgtcgctgatccgctgattattgaaacatgccggagagtggccccggacgtagaaattcacctcagcacacagcagtccctttccaactggaaagcggtgcagttctggaaagaagaagggcttgaccgcgtggtgcttgcccgtgaaacgagcggactggaaattaaagaaatgaaggaaaaggtggatattgaaattgaaacctttatccacggcgccatgtgtatcgcttattcaggccgatgcgtgctgagcaatcacatgacggcccgggattccaatcgcggcggctgctgtcagtcctgccgctgggattatgacctgtatcagacagacggtgcaaacgcggtcgcgctctatgacgaagaagacgctccgtttgcgatgagcccgaaagatttaaaattaattgaatccattccgcaaatgatcgagatgggcatcgacagcctgaaaattgaaggccggatgaaatcgattcattacgttgcgacggttgtcagcgtgtatcgcaaagtcatcgacgcatactgcgctgatcctgaaaactttgtcattcaaaaagaatggctggatgagctggacaaatgtgcaaaccgggataccgcgcctgctttctttgaaggcacgcccgggtatgaagagcagatgttcggcgaacacggaaagaaaacaacatttgattttgccggtctcgtgctcgcgtataacgaggaaactcaaatggtgacgctccagcagcgcaatttctttaaacaaggtgacgaagtggaatttttcggtcctgaaatcgacaatttcacattcacaatcggcactatttgggacgaagacggaaacgagcttgatgctgcccgccatcccctgcaaatcgttacatttaaagtagacaaaaagatttatccgagcaacatgatgagaaaggggaagtaatcaccaatgggtaagagtcctgtagttataggcatcgcaggaggttccggatcaggaaaaacaagcgtcacccgttccatctatgaacagtttaaaggacactcgattttaatgatccagcaagacctttattataaagaccaaagccatcttccgtttgaagaaaggctgaacacaaactatgatcacccgctcgcatttgataatgactatttaatcgagcatattcaagagcttttgaattaccggccgatagaaaagccgatttatgattataaactgcatacgcgttctgaggaaaccattccggttgagccgaaggatgtcatcattctggaaggcattctcgttctcgaagataaaaggcttcgcgacctcatggatatgaaactttatgtcgacacggacgcggatctccgtatcatcagacggattatgagagatattaacgaaagaggccgttcaatcgattctgtcattgagcagtatgtgtccgtcgtcagaccgatgcacaatcagtttgttgaaccgacgaaacgctacgcggacatcattattccggaaggcgggcaaaaccacgtcgcgattgatctgatggtcacgaagattcaaacgatccttgaacaaaatgcaattttgtaataccatagcatagacataaataactcagaccatattatgtataggctggaagggaatgagacagttcccttctttccctgtttataaaccgaaacatttgcagaaaacacacattcagtttaagataaacagtacctatatgggagagaagaacgaggactgccctgtgttctcattcttgattttttcgtttatgctctcatacataatcacacgttattgttgagggacaaccaccaaggagtgaaggaacatggcacaagaaaaagtttttccgatgactcacgaaggaaaacaaaaacttgaacaagaattagagcaattgaaaacggttaaacgcaaagaagtagtagaacgcattaaaatcgcaagaagcttcggagatctgtcagagaactctgagtatgattctgcaaaagaagaacaggcatttgtggaagggcgcatcacgacgcttgaaaacatgatccgcaatgcgaaaatcatcgaggacgacggcggttcaaatgtagtcggtttgggaaaaaccgtatcattcatcgaattgccggacggtgaagaagaatcttacacgattgtcggaagcgctgaagctgatccgtttgaagggaaaatttcaaacgactcgccaatcgccaaaagcctgctcggcagaaaagtggacgaagaagtgacagttcagacgccgggcggagaaatgctcgtgaaaattgtgaaaatttcataagatccgtttaacattgaaacacctcgtccaaaatgtggatgaggtgtttttttatgatcgtatcaaaaaggctgaaagcggccgtgatttgttttctgctcgtgtttttctttctgcttgcgaggctggctgaaattcagctgtttttcacagaatctttttcaaaatccaatattaatctgattcaggaaagcgtcaagcagcggacggaagaagtccttatttcagacggacgcggctcttttcttgatcggaacggcaaagaactgaccggaaaaaagcagcctgccgtcatactgtttccctttctcgtgacgcaggattggccggttgaccgggtatcagacattctcggaatgaaacagggggagctcaggcagctgctcacggaagcgaaaaaaccggtggtcctgaacagcagaaaaataaaacatttgacgaaacaatccgtgtcaaatatcaattctttgaaatatcccggcatttacggcgtatatatgaaagacagcaaagaaacaaacatagccgctcatctgttgggcgcgacaaaccaggaccctgagcttttgaaaaagaaataccccggcaggaaggaactgccgatcacggcaaagatcgggacaagcgggatggagcggacgtttgatgagtttttactggcggatcaggacacaaaacttttgtatcatgtcgacggaaggggaaaccctttattcggaatggacgtcaaatatacggctgaagcaaacgcgttttatccgctgcaagtcaaaacctccatcgaccgcaatattcaaaaagcaatggaagatgtattgaaagaccgcgggttaaaaaaggggggagccgtccttttagacattgaaaaaagcagtgtgctcggaatggtatcaaagcctgacgccgacatgtcaaagcagcagacactgcaaaattacatgctgacgccgatttatccgggatcagtatttaaaacggtgatcgccgcagccgcaatagaacaaaacgaagtgaagccgggcacatcctttaactgcaatctcaacctgtacggagagccgggggatgacaaaggcacgctcagttttggagaaagctttgcccaaagctgcaattatacgtttacaagccttgcggaaaaattgatcaaaaaagatgattccgttattgaaaacatggcggaaaaactcggtctcacccagcgggcggggtgggaaggcaagctgtaccgggaagacggattcaggcagctgtataatgaaaaaagcggggtcatttggggagatgacaaagacaaaaccgtaaaaaaagccgtcgcacagacggcgatcgggcaaaaaaacgtgaaagtcacgcctcttgaagtcgccaatatgatggcggcgatcgcgcgcggcggtgaaaaaaaacaagtcaaaatcgcggacaaaattgaatacaaaaacaaaacgacaatggcgtcattcaaagaacagccgttaaaaggggaaaacatcgacaaatatacggcgcagcagcttcaaaaaattctcagagaagtcgtcacctcaccgaaaggaaccggccgaaggtttcaggacctgccgtatgagatagcaggcaaatcgggaacggcccagacgggaatgttcacaaaagaaaaacagacgctttaccacaaatggtttgcgggatactttcccgcggacaagccgaaatacgctctcgtggtgctgcacatggacacgccgggggataaggctctgacaaatacagtgttttatgatattgttaaaaaggtacatgaaaatgaaataaatcagacatagaacaaccgctcagcccatgttaaaatatatgctgagcaagagggataaaggagtgcagaatgattgagcaataaacaatctcgttttgaaaaccgtgataagcgcagaaaagcaaatatggtgcttaacattttaattgctatcgtatctattcttattgtcgtcgttgccgtcagcctcttcattaacagtccgtcgagcgacgtgagcgaaaaagcggacacgagccagaagcaggaaacacctgcatcaggcaagacgaagcagacatccgatgaagacataaaagacagcaaaaaagatacggcatcagacgatgacaaaaaagataaacaggataaggacacatctgattcatcttcagactctgacagcaaaaaagaagatgattcatcgaaaagtgatgacagcagcaaaaaagactctgattcaagcgatccttttaaaggcgcaaaaataacagagggcggctcatcaagcgatgtcgagaaaacaattgttaacccaaaatggaaagcggtcggcacaaagcagacgggagaacatacggcgacgtatgactcaagctctgaagactggtccgaaatgcttgacgccatctcttacgcaacaggcgtgtcaaaagatcatatgacagtgctgtggctcggaaacaatggaagcccgcaagatgcgaaggggaaagttttagacaaaacgaacggcaaaaagtatcaggtcaccatcacttggaaagacaaaaaaggctggaagccgacaaaagtagaaaccttaaaataaccgcaaaaaagcagctgattattcagctgcttttttctgtcatacgtcagctgaaaaatgcaccgacgcgctgtaaaggattctgccgtcaacggccgtcacctgatgggatacggaacggacgcgaagcataatcgcctggttgttttcaatctgaacgtttattttcttttcaagctcctgcaaagatgccgcttcgaaaaattctactttatctttgattaaatccaattgaaaattcatcagtacagatcctcctgatttttcttctgagtcaatgaaagtataagcctttctgccgtaattgcgcaataatcccaaagtattttagtacccttccattcttttttgtgataggataggaactgttccacgattaatccatactatactcataggaattataaattatggagagtgaaaaatatgggccgtgaatttattcctttatttgaagattgggcagcgacttatgatgccacagtgcacggggctgacaaacaatatgccgctgtttttaaaggatatgacaacattcttgacagcattgtcgcactttcaggttcaaacgttttagagttcggaccgggaacggggaatttaacggcgaaattagccgccgcgaacaaaaaggtgtttggtgtagaaccgtctccgtcaatgagaaaactggcggctgacaagctttctgacaaagccgtgttcagtgacggagattttctggagtttcccgctccgccttttcaaatagataccatcgtcagctcgtacgcctttcatcatttaaccgatgaagaaaagcgaacggctgtaaagcagtatggcgcaatccttcagaagcatgataaaatagtgtttgccgatacagtctttaaagatcatgaagcttatgatgtagccattaaaaaagcaatccgaaacggctatcatcaattagcggacgatttaaagacggaacattatccgacactcgggacaatgaaaaacatcttttcagaagagggatttgccgcgcggtttacgcagcaaaatgactttgtctggataatggaggcgattaaacggtaaatcgaagggattgtgtataaatgaaactggcagtcatcggagcaatggaagaggaagttacgattttaagaagcaaactgaaagacgcaaaacaagagatgatcgctcactgtgagtttacaactggcagctatgaaggcgtcgaagtcatcttgctgaaatcaggtatcgggaaagtcaacgcggcgatcagcacgacgcttctgcttgaccgtttcaaacctgattatgtgattaacacaggctcagcgggcggttttcatcatacattgaatgtaggcgacgtcgtcatctcaacagatgtccgccatcatgacgtagatgtgacggcgtttgactatgaatacggacaggtgccgggtcttccggcagcatacaaagctgatgaaaagctgatcagtattactgaggaagcggtttctgaactgaacggcattcaagtcgccaaaggcacaatcgctacgggagattcttttatgaatgatccgaagcgggttgaagacgtacgcgccaaatttgcggatttgtacgcggttgaaatggaagctgcggctgtcgcacaggtgtgccaccagttcaaaacgccttttgttgtcatcagagctttatctgatattgccggaaaagaatctgacgtttcatttgataaatttttagaacaggctgccgttcattcaactgagcttgtcctgaatgtcatcaaacgaattcactaagcgggggattctcgttctcctccgcttttcaaggaggaggacatatattgaacgtgataacagatattacagaactgatcggaaatacaccgctgctccgtctcaagcattttgatctaccggagggaacagcggtttatgctaagcttgagatgatgaatccgggcggaagcattaaagacaggctgggcgggatgctcattgaagatgcgcttcgcacgggaaaggtgaaaccgggcggcgttatcattgaggcgactgccggaaacaccgggatcggactcgctctgtgcgccagaaagcatcagcttcgcgccgttttttgcgtcccggagcatttcagcagagaaaagcagcaaattatgaaagctctcggagcggacatcgtgcatacgccgagagaagaaggcatgcagggagccatccgaaaagcgcttgaactggagagagagattaataattcttatgccgttctgcaatttaaaaaccgagtaaatccattgacttactacaaaacgattggacctgaaatatggaacgcgctcggcggggatatccacgcttttgtcgcaggagcgggttccggcggcacctttgccggtacggcagcttatttaaaggagaaaaatcctgccgtcaaaacggtgatcgttgaaccggaaggctcgatcctgaacggaggagagccgcatgcccataaaacggaaggcatcggcatggagtttatcccggattatatggacgagaaccattttgacgccatttacacggtggaggacgatacggcgttttcgcttgtcagagaagcggccgagaaagaaggcctcttaatcggaagctcttcaggggcggctctttatgcagcgcttgaagaagcgaaaaaagcgcccgccggatcaaatatcgtcaccattttccctgacggcagcgatcgatatataagcaaaaacatttttcaaggaggtcagtaagatgaagaaaaaaacgctgatggtgcacggaggaattacgggagatgaaaaaacaggagcggtttccgtaccgatttatcaagtaagcacgtaccggcagccgaaagcgggcgagcacacgggttatgaatattcaagaacggccaatccgacgcggacggcgcttgaaagcttaattgcagagcttgaaggcggcgcggcgggatatgcgttcggctcaggcatggctgcgattactgccgtcatgatgctgtttgacagcggcgatcatgttattttgacggatgatgtatacggcggcacttaccgggtgatgacaggcgtgctgaaccgcttcggcattgaagcggactttgtcgatacgagcagtgaagaaaaagtcaaaaaggccattcgcccgaatacgaaagccatttatatcgaaacaccgacaaacccgctattgaaagtgactgacctcaaactgatgtctgacatcgcaaaagaagcgggcgtattgcttatcgtcgataatacgttttacacgccgtatttccagcagccgctcagcttcggcgctgacatcgtgctgcacagcgcgacaaaatatctcggcggccacagcgatgtcgtcggcggcttagtcgtcacggctgataaagaactgggcgaaaagcttcattatgtgcaaaactcaacaggcggcgttttaggaccgcaggattcatggcttttgatgagaggcattaaaacactgggactcagaatggatgccatcaatcacagcgccggaaaaatcgccgggctgcttgaagcgcatgatgccgttcagacgctttactatccgggatcagcgaaacatccgggccatgagctgacaaaagcgcaaagctccggtttcggcggaatgatttcctttgatgtcggcagcagcgaacgcgtcgacgcgtttttagaaaaattgaacctgtttacgatcgcggaaagtttaggagcggttgaaagcttaatctccgtgccgtccagaatgacgcacgcttcgatcccgcgcgaccgccggcttgcgcttggcattaccgacgggctcgtgcggatctcagtcggtattgaggatactgaggatttaacggcggatgtgaaacaggcgcttgattcacttttataaagaatggatagatttacattctctgtcggctgtcagcttgtattataatgttggtagactataaaactggcaggtgaccttatatggagaagaaaagactgaaatcattaatagaagattttaagcattacgcatttattctgcttgcagtcagcaccttcatttatatcggcgcggttcttcccggacaagggctgactgcgggccagaaaatgctgatgtttgtaacggattgtgtatttttagcgggcgcttatttctgcgttgaccgttcacttatttataaaaagaggctggaagaggccgaagaataaaaaaaagccattgtctttgggactgccccccgtttttgagacaggggtcaaaacaccttttaaacagccaattgccgatagtttatcggtgattggttgtttagtttggtttgaatacgaatattgttataataatgaatgtattctatgacagtgcgttctacgatggcagtcgtagttcgatcaatgctgttaagatagaacgtttcagactttagcgaggaatgaaacgattcgatggaggcattatcagcgggcgtccctttgcgggacatgctcatggtaatgccttttgttttaacagctttttgatactcgtaagatgtatacacagaaccttggtcactatgtaacacgcagttctcaggcagcattggtagctgatcaagtgtgtctaagacaaaggctgtgtcctgcttatccccaatagtaaaagcaatcacttctccattgtataaatctaatatactggaaaggtacaattgtttctgtccataaggcaaatatgtgatgtccgttactagtttttcaagaggacgatcagactgaaagttccgatccaatatattatcgaccacggcatatggctgcccatccttcttgcgctttttcaccttaacccgacactgccattgatttttctgcataatacgttgaaccgttttatggttaatacacattctcttttttagtatggctgtgatttttcgatatccatatcgatacttgtgctctcggcacaacgtgccgatttgtttttccaaatggcgcttgggatgatccttcatcagattcttcttccaacgataataagacgctcgagagatacctaaatgaatacagatatcctgtacggtcattgtgctgtgcaatatttctacaagttcgactgacgtttcgctatcaacttcctttccaattcgttgtacttttttaaaacttcattctgttgtctcaggtaacgaatctctgcctgcagtttctctaaatcggaagaatactccggaccttttccgtaagtgtattgctttccaacaggctgttcgaatcgatgtgtatcaccagccttataccatctaacccatgtctgaacctgtgtcttattcttaatattcaactcctgcaggatctctttcataggtacgcctgccaatctcatttctacagccttctgtttcacttcaaccggataactcactcttgtccccatagaaaaaacacctccaagtctaatttcggataacaatcatccgtattcaaacttgaaggtgtttttatttgtctcatcttatggggtcagtccccttttgacaatggctttttcgtttcttattcagacggggtttcgcgtaattcttttcccattccttttaaaaactgcagcccgaagccgagcgcgcggttaatatcaggatcaccgagggctttcatcagttcaaacatactgactttcctgtcctcttttaaaaatctttgcgcctgatccgtcccggccatggcgctttctaaaagtctgcccataaattcgggatcagcttttgacagcgcgcctcccgcggccatcatcgtattcaggagattggtgacaggttcccgggaaatctgtccgagtgcgattttggcaatctcctcttttgcctggagcatatagccggcggcatcaaaaatgcccaagctattcagctctgccatgatggacatcgttttcgcgacggcttcttcattttctgcgagaagcgtcttcagctcttctagtttttcagctttcagctgttcctctgttttcgtttctttttgaatttcagtaattgggcttgccataatgtttcctcctttccttaatcagttaagtgcacatagcccggacggttccattttcgctgagcttccacaccgttttgcggatgacgttttttgttccgcggattcgttttcggaagcggcggagtatcacaggaaccaagcacttccatgcggacttttgtctgcttataggcaggtgtatgtgtccgtgaatcatacgcaggcccggtcaggaaattaatcgcagaatctttatctgtagagttcatcggcagataaagctcattcgcgcggacgcggtctgtcacaagcgcgttcaatttaaccgccccaaaaggagagacgagccggatcattgtcccgtcgcaaattccgcgttcagccgcgagctccggcgatacttcaacaaatacatccggaactttagactgaatgccttttgacttgtttgtcatgtttccttcgtggaaatgttcaagcatccgtccgttgttaatatgcaggtcatattcttcagggaatacagcaggctccacccaatcgctcagcgcaaaacgggcttttttgtccgggaagttaaagccgtcttcataaagaagcggagtgctttctcccgtaaagcttccccacaagaagctgttccagccgctaagaacgtcgtagcttgcttttccgaacagcggagaaaggctcgccatttctgagaaaatgtcgctaggatgcgtgtaattccaatcagcgcctaaacgattggcgacttcctgaataatccaccagtcgggttttgcatcgccgagtgtcggaagcgcctgatacaatctttgcacacgccgctctgtgtttgtaaatgttccgtctttttcaagagatggaaccgcaggcaggatgacatccgcgtattgcgccgttcttgaaaggaaaatatcctgcacaacaaagaaatcaaggctggataaaatgttatgaacatggttggcgtttgaatcgacgagcgccatatcttcaccgacgagatacatggctttcatgtttccttcttcaatcgcatggagcatttcgatattatcaagacccggcttgccgtcaatttcaacaccgtaagctttttcgaatttagcgcgtgccgcatcatcggtaatatgctgataccccggaagccagcctggaagagttcccatatcgcaagcgccttgaacgttgttatgtccccgcagcggataggctccggcgcccggacggcggtagtttcctgtggcaagcagcaggtttgaaatcgccgctgatgtatcagagccgcctgtattttgagtaacgcccatgccccaaagaacacaagtgccgtctgcatcacgaatcatttcggcaatgcggatgattgtatcctgagaaagtccggtgatgcgctccgcatattccaatgtgtatttttccagcgtttctttataatcatcaaagtagttgacattttcatcaataaacgcttgatcgtgccagccttggtcaatcatatatttcgttactgccatgagccagacctggtcagtcccttgttttgggctgataaagaggtcggaccgttcagccatttcatttctgcgcagatcggcaacaatcagtttttggccgtgcagtttatgggcgcgtttcacgcgtgtggccagaaccggatgtccttccgccggattggcgccgacgatgagcacgaggcccgcttttgcgatatctttaattgtgccagcgtctccgcccataccgacggtgcggaataagccgtccgttgccggtgactggcagtagcgtgagcagttatccacgttgttggtttcaaatacttggcgcgctaatttttggatgacgtagttgtcttcattcgtaattttagaagaagaaataaaaccgacagaaccatttccgtgttcggccttgatcgaaccgagtcttgaagcgacaagatcaagagcttcttcccatgacgattcaacaaatgcgccgtttttccggataagcggttttgtaattcgttcttccgaattcacgaagtcccagccgaatttccctttcacacaagtggaaatcgcgttaaccggagcatcggaaacaggctgaattttaaggatgtcacgtccttttgtccatacttcaaaagagcatccgacgccgcagaacgtgcagactgtttttgtttttttcgtccgtttatcgcgcatagccgcttccacttcagacacggcgaagatgcttgtatagtcgggttcaacatttttcactaaatcaatcatcggttccatgacatcttcttttattcctgtcataaatccggcttggccgatcattgatttttccatcagtgcgttacaaggacagacagtgacacactggccgcagctgacgcaggaagattcattaatggcgacgccttcatcccaaatgacccgcgggcggtcgcgctcccaatcaattgaaagggtctcattcacctgaaggttttgacacacttccacacattggccgcaggcgatgcattggttcggatcatagcggtaaaacgggtgagacatatcaaccgcgcactttgaatcatctttcggcgtatacggatatttctgatgctcaatccccatcatttccgctgtattatggagtgtgcaattgccgttgttgttatcgcataccgtacagtaaagcaggtgattctcgagcaggcggtccatggcctctgtctgagcctcttttacccttcccgacgtaagcgagatggacatcccgttttctgcagccgtggaacaagagcgcttcaatttcccgtttacttcaacaatacaggtgtcacatgtttgaatcggatccacttccggtacatggcaaatttgcggaatctcaattccgttttggtttaaaatatctaaaatcttagacccctctggtgcttcatactccgtgccgtcaattttgacacggatagactgaacgtctgtcacttccaattcccctccatcttttaaactcgaaaaaagccatgcacatagataccggcctcctgtccggagaacggtataaatacgcatggcggaatagttcactagcaagtcttactaacagaccaatcctatttgtataaaacgatagactcataacacgtttcctattacaaatccatcttcactgcttttattataaggtgatatttattataatacaatacgaaaggaaaactttaaccaagtgaaatgtcacaaaggggaaccgggaatgtctttcataggctaaaatcggaggggacaatatgtctaaaaaaattcatgaatttaacgatattatccggaaattgcgcaaagaattatttggaaaggggcctgaacgaattcacaccgtttttgtggataacatggcggtatctacactttacggcaatctaagcgcaagtgagcagtttatcgcacgcacgcctgaaggaagagaaatggttcatgcggcgcgaaccagcttaattcaggagctgtattcaaaacaaacgcctgacggaatggaagagctcatcggagcaaagcttgtgcatctgttttcagatattaaaatagaggaaaatattgctgtatcggtgtttgtctttgaccgctcaattgaagagcataaagaagaaatcaaaagctgacaatattcaattgacacgaaattgtcacatttgatatgatatgaactgccagcagtggcctaaggacgattttttatggaatgtgtgcatgatctgtacatattctataccgcatattttcattctgcttgatattgttgtatgggtatgcatacaagttaggcagcattcaaaccccgttttttcagacgggttagttgaatgctgccttttttgttaggcgtctttggaaactgcgggctgaaatgataaatggaggggttattatggcttttcgtaaaccggacgaaatagcggagcttgcggtcgaatcaggggtaaaaaaggtgcattcaccgctttcagcactgattgtattaggatttttgggaggagcgtttatcgcactcggttatttgcttgatatccgtgtcatcggcgaccttccgaaagaatggggaagcctgtcgagtttaatcggggcgtccgtgtttcccatcggattggtgctcgtcgttcttgccggcgcggagctgattacgggaaatatgatgtcggtatccatggcgctgttttccagaagaatatccgccggtgcattggtgaaaaattgggtgatcgtgacgttgatgaatcttgtcggcgcactgtttgtcgcttactttttcggacatgttgtcggattaaccgaaacaggaccttacttggaaaaaacaattgcggtcgcacaaggcaaattggatatgccgtttggaaaagtcattgtttcggcgatcggctgtaactggcttgtctgtttggccgtctggctttctttcggggcagaagacggagccggaaaaatcgcgggtatatggtttcctattatggcgtttgtcgcaattggttttcagcacgttgtagccaatatgtttatcatcccggctgcgatatttgcaggctctttttcgtggggtgatctgattggcaatctcattccggcctttatcggcaatgtcatcggcggggcagtgtttgtcggccttatttattttattgcatattcaaaaaaagatcagaaaaagcaagggatgaaaagagtttcctgaggtaagaaagatgccggaaaacacggacaattgaagcggaatgccagcacattttccgtccaaatcttgaaaaaaatgtttacaaaatggaagctgatggatatacttacaaagtaagaaaaaagcaaagggaggttgaatcacatgacgacgttaaacggcaatcaaaatctacaattgaaccgattcagcctgtggaagagttcgtgtccttccttaacctctgcctgtcaagtacgttaatttcggagtatcaggacattcgcagctccccgcagggaaagaagcacagtcttcttttgtctgcggatttagtctgcccgcagcgcatatgaactttgctgcgggttattttcgcttgtgcggatattgaaagggggtgagcgataatgaccattaatcttttctttgtaacactgaccatttcaaagcgttttaaaagtgcggaagagtatgaacgagaacagcaggtcgaagagttttataatgaagcgaaagaacgccagctgaaacacttttatatgaactaacggacacgaagggccaaaacggaggagaaggaggagattatcatgttcagaattgaactgctgaatcattacacaatggagaaggaccaggtttagcgaggatgttgctgtcacgtcgcagacggcctgcataccatggtaaagaaagaaaaattggtaagcgggtgatagcatgcaaggcggtcagaacagaattccatccatcgggcacgggtatgcgtcaatgccccattcatttaagcacggctacggcaacccgtatcgccggcagagaatggcggcgctttcccggcagacaagatatatagcaccgtattattggtactagagcaggcggaaaacctacgttttccgtctttttttttatgaaaacaaatataaatttcaaataaatcgaaacgttcatgaagagaagtgcgtctagttagtacctcatactaatacgaggtaatattatttctgaataataaatcacaggaatggaaaagcgggtgttatacaatgttgcaacatacatcttcagcattaaaacgaatgcgcgcgaaatactttgctgcatcagaaccggcagagtcagtcattcagcaaatcttgatggacatacaggaatacgaccgcattttggaaatcgggaccggaaacggctcaatgtttaaacaaatcatcggacagcttgaaaagggcagtcttaaaagcatagaaacatcgaaacgtaaaatacggaaaacacagcgcgcaaaccgttcggttataaaagccgggctcggaaacattcagcaggggaggccggaaagcataccgttccgcgaccgcagctttcataaagtcttctcattacatactgctgaaacagtcagcgattaccggacggcatgtaaagaagtgtaccgcgttcttcaaattgacgggtgtttctatatggttttgaaaccttcgcggatgagtgaaaaggatgtgattgaggtgctctatgatcagcatttcagagacatttcagttgtcagcagagattcattccattttattactgccattaaatagaatatttcttgggaaataaaaagagctgcttaagtcactgcagctctttttgtgaaattgggcatatttccttatttttggttatttcacatatattttatattaaaaaaagtttttttcttatacaatggtaatcagatgaccgtacattttaaatattttgaacaaacggaatgaatattcattccgcgtttagaaagggggatgaaatgacagcttcaaataaggttgaactcattatgaaagcgtcgcttactttgtttacagatagaggatttgacgccacgacgattccgatgattgccgctcaggccgatgtcggaaccggcacaatttaccgttactttgacagtaaagagacacttgtgaacgtactgtatcaggaaagtgcgcagcgttttatgaaaaaagtcaaaacggactttcaggggatatctgtaagagaagggtttcatcacctgttttattgtctgattgattttacgaaggaaagtgagtatgcattgttttttcttgaaacgaataaggacgcctactttctgaatgaaacgagccgtaagcttcttgatgaaataacacagatgcttgacgtcttttttcagcgcggcaagtctgaaggcgtgctccgcaatctgccgtccaatgtgctgatagcgctgctgctcggggcatatctcaaactctatcagcttgtccggacgggaagcgtcgaaataacaaaaccgtttctgaaagaattggaacaatgttcttgggatgccatcagaactcattaattattcgccgaaggaaggaagatcgatatgaaacagctaagcgctataccgcagccgaaaacatacggacctctgaaaaatctccctcacttggaaaaagaaaaactgtcacaatcgctctggaaaattgccgaagaatacggcccgatctttcgttttgaatttccgagctctgtcggggtcttcgtatcaggccgcgagctcgcggcagaagtctgtgatgaaaagcgatttgacaaaaatctcagcaaagccctgctgaaagtccgtgagtttggcggtgacggactatttacgagctggactcacgaaaagaattggcagaaagcgcatcggattttattgccgagcttcagccagaaggcgatgaaaggctatcattcaatgatgctggatattgccatgcagctcgtgcagaagtggagcagattaaatccgaatgaagaaattgatgttgccgaagatatgacgcgcctgacgctggatacaatcggcctgtgcggatttcattaccgctttaacagcttttaccgcgacacacagcatccttttatcacaagtatgcttcgtgcgctgcaggaggcaatgcgccaatcgcagagacacagcctgcaggacaagctgatgatcaaaacgagacatcagttccagcaggatattgaagagatgaattcgcttgtagaccggatcatcgctgagcggagggaaaatccggatgagaatctgtctgaccttttagcattgatgcttgaagcgaaagaccctgtaacaggggaaaggctggatgatgaaaatatccgttatcaaatcattacctttttgatcgctgggcatgaaaccacaagcgggctgctttcttttgcgatatactgcctgctgaaaaataaagataaattgaaaaaagccgttcaggaagccgagcgggtgctgacgggagagacccctgaatataagcagattcagcagctgacatatatccgcatggtgctaaatgagactttgcggctgtatccgactgccccggcattttctctgtacgcgaaggaagatacggttctcggcgggaaatatccgattgcgaagggacagccggtgacgattctgactccgcagctgcaccgggataaaagcgcgtggggagaagatgccgagttattccgtccggaaaggttcagtgatcccgcggcaattccggctgatgcgtataagccgttcggaaacggacagcgcgcatgcatcgggatgcagtttgccctgcaggaagcgacaatggtgctcggccttgtcctgaaacattttgaactgattgatcatactgattatgagcttacgattaaagaagctctaaccattaagcccggtgattttaaaatccgtgtgaaaaacaaggacgtgtccaatcatcagcccgtacaaaaccataaagctgaaggcagcggtcacaaagaagaaacgaaagaaatcccgtcccacggaacgccgcttctcattctttacggttcaaatttgggaactgcggaaggaatcgcggaagagctggctgatatcggaagaagcaaaggattttcaactgaaaccggcccgctcgatgattatgccgggaaactgcctgtaaaaggcgcggtcgttattgttacggcttcttataacggggcgccgcctgataatgcagcgggttttgtgaaatggatggaaacccttgaagatcaggaattaaagggtgtttcttacgccgtcttcggctgcggagaccgcaactgggccgccacttaccaaaggatcccccgcctgatagacaaagtgcttgaagaaaaaggggcaaaacggctgacctctatcggggagggcgacaatgccgatgattttgagtacagtcaggaagcctgggaagactcattctggaaggacatcatgaaggcttttcatatagaggccgctccaaaacagacaaacaaatcacagttatcaatcgaatacgtaagtgaagcagccgagacgccgattgccaaaacgtacaaagcatttgaggcggaggtcatcacgaacaaagagcttcataccgaaagcagcaagcgctcagtccggcatattgagctgcgtctccccgaaacagaaacgtatcaggaaggagatcatctcggggtgcttccgcaaaacagcggggaactgatcagccgtgtcattcgccgattcggtcttgatccgaaccagcactttaagatcaagggccggcagctgcctcatctgccgatggaccggccggttaatgcgccggagcttttggcgtcctatgtagagctgcaggagccggcaacgagagcccagcttcgcgaacttgccgcacataccgtgtgcccgccgcaccaaaaagaattggagcatctttattctgatgatgcggcatataaagaaaacgtgctgaaaaaacgaatgaccatgctggacctgctggaagattatcctgcatgtgaactgccgtttgagcgctttttagaacttctgccgtccttaaaggcgcgctattattcaatctcaagctcaccgaaggcaaccagcggggagctcagtatcacggtcggcgttgtgacggctccggcatggagcggccgtggggaataccggggcgtggcttcgaactatttagccggattacaaaaaggcgattctgccgtctgtttcatccgctcgccgcagtcgggtttcgcattgcctgaaaatccgaaaacgcctctcattatggtcggagcaggcacaggaattgcgccgttcaggggatttatccaggcgcgggctgccgaaaaaatgtccggtaacagcctgggtgaagctcatttatacttcggctgccggcatcctgaagaagacgatctgtacaaagatgaattcgaccatgcggagaaaaacggccttgtcaccgtgcatcgggcgtattccaggttagatcaggactgtaaagtatatgtacaggatgttctgcttcgcgaggctgcacaaattattgcccttcttgaccaaggcggccatctctatatatgcggtgacggaagcaaaatggctccggctgtcgaaaatgtactgcttcaggcgtatgaaaaggtgcataacaccgattcaaaagtttccttggagtggcttgaacagctgcaggcggaaggaagatatgcgaaagatgtttgggcaggtatgtaacagaagagtgagacaactgaagaatgttttttaattgaagaaagccggcacgatatttgaaatctactgaatcaaaaggaatagttatagggagtatcgtgccggccttatctttagtatcggacaaaaggcacaaatctttaatgtttttattgatttacatgcaggcggctatgtcccttttttctgaattccgccagaaataaaaccggataagacagcaatagcaaaaccgaaataaatgaaatgataccgatccaatgaaaatgcgtccaaaagaaaccgccgcaagacccggccacgcttgaaccgatatagtatgcaagcagatataatgaagaggcttgcgcgcgctgatcaccggctgcgcggccgacccaggcgcttgcgatcgaatgagcgccgaaaaagccgaaggtaaagacggcaatccccgcgattttgagcgcaagctggggcaaaagtgtcaccgctgcgccggcaagcataacaaaaatcgcaatcttaatcatttttccgcttccgaaaagatctgcttttttccccatatagaccgagctgaacgttcccgcgagatagacaataaaaataaaaccgatcacagtctgcgacaaatgataaggagccgccattaaatgaaagccgatataattatataatgtcacaaaactccccattaatataaatcccagagatattaacaaaagcagccgtttgcggtgcaggaccgctccgtattccttacatgccgcttttacgcccgcatgccgctgagatgaatggcgcggagccggaagaaaacgccaaaacaaatagcttaatacaatagaaagaatgccgatgatggcaagcgccggccgccagccgaatacatcggtcagaagccccgttaacagcctgccgctcattcccccgatgcttgtgccgctgatatacaagcccatcattttcccgaggcccttcggatcaaactcctcgcctacatatgtcatagcgacagccggaactcctgccaggaaaataccgagcagcgccctcatcgccaaaagcgccggaaaggccggactgaacgctgttaatagacctaaaacagaagtagctgttaacgacagcaccattaatttttttctgccgaatccgtcagacaacgaagcggcggccaataatgaaaatgccaaaacggctgttgagatggataaagttaagctggcagccgcagcggaaatatgaaactcttccgaaaacaaaggcataagcggctgtgtcgtgtaaagcgtggcgaaggtcacaaagccgctgataaacagagccaagctggcctttctgtaagcctttgtgtgaggctgaataaacgtcatgaatgtccctcttttctcactgttggttatatatgtatcgtacgcttttcatttcaatgtgtctaatttataataactatagaattaatgcgtgtaggttatgaagaaaggggagaaggagaaaatggagcttcatcaaattgacaacttcattgcggcggcagctcatcagcatttcacaaatgcggcaaaagaaagaatgatttctcagccggcattaagccgatcgattatcaggctcgaagaagaattaggcgcgccgttattttacagagagacaaaagccgtccggctgacaaggcacggagagcagttcttaataaaagcaaaacaagcgagacgagctttaaatgaaggcgttgaacaagtgaaaaagaatatgagcctggagcacggcgaaatatctgtatcttttcttcatacgctcgggctgcgcttaatgcctcagctgattgccgaatttaaaaagctatacccaaacgtgaccttccggctttatcaaggcgcaaatgaaacgcttcgcaaaatggtggaaacgggagatgcggatatctgtctcagctctccgccgcttcccagcgagcttttacaatggacagtgctggagaaagagcctctttatgcggtgctacctgagaaccacccgcttgcaggaaataaaagcattcaaatgaaagagatgcaggacgaggattttgtgggttttaaaccgggatacgggctgaggtatatgtttgatctgatgtgccgggatttgaatatacacccgcatctcgcatttgaaggagaggaagtgtcaaccatattaggactgaccgccgcgggtctgggggctgcagtgctgccgaaaaccgcggagcattcatactttccggtcgtttttcttccggttgcagattaccaatgcgaacgcaccatagcgttagcccagctgaaaaaccatgctctctctcccgctgctgagcgttttaaacagtttgcacttgagtattacaaagcacgcaactgagcggtcattttattaaaatcaaagttgaaaataaagcagaaagaaatacagaaaacggaggaaaaccatggcgaaaaaaacagtgaaaacaaatgctgtccgtatcattgagcagcaaaacattccctatgagctattaggttacaaaacagaagggggacagcccgcagacggtctttccgtttcacaaaaaatcggatacgctgccgaatatgtttataaaaccttagtggcatctgcaggaactgatcattattacgtctttgtcgttcccgttgcaaaagaactgaatctgaaaaaggctgcgaaggcggcaggtgagaagaaaatagaaatgattgccatgaaggaccttttgggagtgaccggctatatacgcggcggctgctctccgatcggaatgaaaaaaaggtttccgacttttattgatagatccgctgaaacactggagtttatgattgtcagtgcggggaaaatcggaatgcagctgaaagcagcgcctcgagatttagccgaagcaagcggggcggtatttacagacattgtataaatgtccggtgaatctaatggaatacacgtttcaagggagaatgataatgaaaaaaagatatgaaaacttgaatggcgtgaagaatgaacatggattcagggacatgtggaaatggatgaaagaacgaagagaaaaaagtaaagacttaagcgagaacattccgaaagcggtcacaagggatgtccgtgatgttgccgtcaatcggacggaaaccgccataacatggatcggccattcttcatttctgatccaaatacaggggtttaacataatgaccgaccctgtatgggcgcggaggatgggttttcaaaaacggctgacagagccgggatatgaattgagcgaactgcctgacattgatgccgtgctcatctcacatgggcattatgaccatcttgattttccgagtataaaaaaactgagaggaaacccggatttttacgtgcctgcgggactgaaaaagctgttcaacaaaaaagaccgcaaaaaggtccatgaaatgaattggtgggatcgttttgagatgcggggggtgaacatatcatttgttccggcccagcactggacacggagaacgctttgggataccgatacctctcattggggaggctgggtcatagaaagcaaaaacggcgagtccatctattttgcaggagatacaggctattttgaaggctttaaagaaatcggagagaggtttcgtattaaggcggctctgatgccgatcggagcatacgaaccggaatggtttatgcaagtgtcacatatcaatccggaagacgccgtgaaagcgtttttggagctgaaggctgacagcttcattcccatgcattacggggcattccggcttgctgatgatacaggcccggaagcactaagcagactgcacggcgagtgggatcggcttgcattacctcctgaaaacctgaaagcattagcgcttggcgaaacattttggctgtaacagcaggttttcgctgccgacaccaatcgtttaaaaacggttggtgttttgttgtcaaccaaaggtgaacagctttagtataaaacatgatttttccggaatctgcggtaaaaaacaaaactttttactcttttgtttcattataaaatgaaaacggtttcgtatgtgtagtatatttaacctatcacaattgctccagcagaaacggacaggaaggatagaaaaacagatgaaatacatgaattcaaggcagaaaaagattttgtatctgttgttatctgaacctgatgactacttagttgtgcaagatttcgcagacagggtccgctgttctgaaaaaacgatcaggaatgatttgaaaacgattgaagatttcctgaatgaacatgctcaagctcagctgatccgcaaaccgggattaggcgtctatttacatatatctgaacaggaaaggtcacggttaatccggcaaatttataatgagcactttacgtgcaggcacaagaccgatgaagaaagaatacttcacatcgcttatgatttattaatgaattcaaagcccgtttccgcaaaagaaattgccgcacagcattttgtaaacagagcttccattaaaaaggatgtaagtgcggttgaagagtggctgaagcgatttgatctcacgctggtttctaaacagcggctcggcttaaagattgaaggggacgaaaaaaacaaaagaaaagcattggcgcgaatttcagatttgattgataatgcggaatttacaagccaatttataaaaagtaagtttttaagttatgaagcggactttgtgagaaaagaaatcaagttattacaaaaaaaacattctatctattttacggatgaaacatttgaaagtttgctgctgcatacattgctgactatccgccgtatcaaaatgaaacagccggtcgccatttctgcaagacagctggacgcggtaaaaaagaagaaagaatatgaatggacactggcttgtttaaaacggcttgagccggtatttgccatccggtttcctgaggaagaagccgtctatttaactttacatataataggcgggaaagtccgctatccatcgcagcaagaaaagaagcttgatcttgaagattctgagctttccaaagtcgtcaggcatttgatcaatcgtgtttcagaactgcaaatgctggatttttataaagaccaggaactgatcaacggattgaacattcatctcgatccggtgttgaagcggctgagctatgatctctctgtttcaaaccccatgcttcacgacatcaagaaaatgtacccttatttgtttcatcttatcatagacgttttagaagacatcaatcaaacatttgatctttatattcctgaagaagaggcggcctatttgacgctgcattttcaggcagcgatcgaacggctgcgccgaaacagtcataaccctaaaaggacgatcatcgtctgccatatgggcattggcatgtcgcaattgctgcggactaaaattgaacgcaaatttcatcacattacggtaaaagactgtatcgcaaaagcggagctgacagagtatatcaaaaagcataaagatatagatttcgtcatttctacgatagggcttggaaatgtaacgatccctcatattgtcgtatcaccgcttttggagtctgctgatgaaaagaagctcagcgcatttctgcaacagcttgatacatcacaccgccgggagcaaaaaacgtttaaaatgctgaacgatacgactccgtttctcgtttttttacagcaagagacagagcaccgttatcaggtcattgaaaagctggcgcaggctttgtatgaaaaaggctatgtagaaaaagagtatggcattcatgcagtaatgagagaaaaaatgtcggcgacaaatatcggggcgggtattgccatccctcacgcgaactctaaatatatcaaacaatcagccattgcaatcgccaccttaaaagagccgattgaatgggggacagaaaaggtgtcgctcgtttttatgcttgccgttaaacacgaagatcaaaacaaggtaaagcaattattcagtgagctttcctatcttagcgagcagccggtatttattcaaaaactgacggaagaaaaaaatgtgatgacgtttttatcgtatttaaactattaaaagcagggaatatctccctgctttttttctgtttatagggaaaaatgccgttatttccggaacttatggtaaaaaaacgcgcttatcacaggctgatttcagtataaagttgagacaagatcttgaaattcagactgcaaaggaggatttatatgaaactgttagcgattacatcatgtccgaacggcattgcccatacgtatatggctgctgaaaatttacaaaaagcagccggcagattaggcgttgagatcaaagtggaaacccaaggcggaatcggggtggaaaataggctgaccgaagaggaaatccgggaagcagacgcaatcattatcgcggcggaccgctcggtgaacaaagaccgattcgcgggaaaaaagctgctggccgtcggggttcaggaaggcatccgcaaaccggaagaattaattcaaaaagcgcttagcggtgaagtgccggtctatcaatctgcttcaaaagctgaatccgcaagtcagcagggcaaaaaacaaaacccgatttaccgtcatttaatgaacggcgtttcttttatggttcctttcattgtcgtcggcggattattgatagcggttgcattgacgcttggaggagaaaaaacaccaaaggggttagtcattccggacgagtctttttggaaaacgattgaacagatcggcagtgcttctttttcattcatgatcccgattttagccgggtacatcgcgttcagcatcgctgataagccgggtcttgtccccggaatgatcggcggatatattgcggcatccggcagcttttacgacagtgcaagcggcgcaggatttcttggaggaatcattgcgggatttttggcgggatatgcggcgcttggaatcaaaaaatgtaaagttcctaaagcaatacagccgattatgccgatcattattattccggtgtttgcctcactgatcgtcggtttggcgtttgtctttctgatcggcgcccccgtcgctcatattttcgcatcattaacggtttggcttgcgggaatgaaaggttcgagctcaattcttctggcattgattttaggagcgatgatctcctttgatatgggaggacccgtaaacaaggtggcctttcttttcggatcggcaatgatcggagaaggaaattatgaaatcatgggcccgattgccgtttccatttgtataccgccgatagggcttgggattgcaacgtttttaggaaaaagaaaattcgccgccgcagaaagagaaatgggaaaagcatcatttacgatgggccttttcggtatcacggaaggagccattccatttgcggcccaagacccccttcgtgtgatcccgagtattatggcgggttctatgaccggatcggtgatagcgatgatcggccatgtgggggacagagtggcacacggcggccccatcgttgctgtacttggagcagtagatcatgtactgatgttttttatcgctgtaacagcaggctctcttgtcaccgctctgttggttaatgtactgaagaaagatatggcgaaatcccccgcgcccggcgaggtgctgcagtctgccgcaccaaatgaagctgcagcggcaaaagaaacaaaggaaccatctcaggctgacagccgaaaagccgggatgaccgaaatcaaaaaactgactgacattatcagtacggacttgattgaaccgcatttatccggcgaaacgagggatgacattgtcgacgaaatgatcgagaaaatgtcccgtaaaggtatgctgctgtctgacagcggatttaagcaggccattttgagccgggaacagcagggaaccacggcgataggtatgaatatcgccattccgcacggaaagtctgaagccgtcaaaacgccgggtgtcgcattcggaataagacgctcgggtgttgactggaacagccttgatggttctgatgcaaaactgatttttatgattgccgtaccgaaggaaagcggcggaaatcagcatctgaaaatattgcagatgttatcccgaaaactgatggatgacagctatcgggaaaggctgctctccgttcagacaaaagaagaggcgtatgagcttctggaagaaatcgaataaagcgggggatgatcatgtctactgaaccgatatttttcaatccggttttcaaagaaagaatttggggaggcgccgccctgcgtgattttcactataatattccgtccgagcggacaggggagtgctgggccttcgccgctcatcaaaatggacagagcacagttcaaaacggcatgtataaaggatgtacgctcggtgaattgtgggagcatcacagagatttattcggaaaccttgaaggagaccgttttcctcttcttacaaaaattttggacgcggaccaagacctgtccgttcaggtgcatccgaatgatgactttgccaaaatgcatgaaaacggggaacttggaaaaaccgaatgctggtatatcattgattgtgcaaaagatgcggagatcattttcggccacaacgcaacaacaaaagaagaactgatatccatgattgagcgcggagaatggggcgggctcctgaacagagttaaggtaaagccgggagatttcttctttgtcccaagcggcaccgttcacgcgattggaaagggcacacttattttagagacgcagcaaaattcagatacgacttacagattgtatgattacggaagaaaagatgcggacggcaggctgcgcgagctccatttggaaaaaagtatagaagtgatagaagttccctctgtccgtgaacggccgaccgttcaatataaacaaacagatgatctgctggcagctgttttaatagaatgtccttatttttcagtcgaaaagtgggttgtaaaaggtgaagcaaatctattccagcatcatcccttccttcttgtcagcgtgatcgaaggagacggaataatgagtgcaggcggacatgaatatccctttagaaaaggagatcatattctcctgccttccggtttgggagaatataaactggcaggccatgcaaattgtattgtgtctcatctgtgatcctcaaaacccttctctagcatcagagaagggttttttattatttttacaaaaaggacggaatttccagtgtatcagtgttttcgttcctgaatttattctctcaatttgtatatctcccgagccattgattcaagtatgtacatagcggggatttgggtggtgacattcgcattttcaacccattcttccgtcacgtaatatgaaatattcacatcggacattttggcaatggttgaatgtttatgatttgtaatactgatgacctggctgccttcttgtttcagctgattcagatgagtcaccgtagaatctccttcacctgaaaccgataatgcgattgtgatgctgttatgacggaaatgggaatgggccggaaagtaaggatctttaatatacatgaaagtttccctaagcacgaaaaatatctggccccgtattcggcgagaattcctgaacttcccactccgataaaaatgacgctttctgcatcggccgcaagggctgctgcttccttcagcttttcttccatctctccgcttactgttctttcaaaaaactcggcaacggaatgatggggactctttaaaatcgtttttttatttgcctccgtatacattttcagcttcaccttaaactccgaaaacccttcacagtttatttttttgcagaaacgtaaaatagaagccgtagatacatgggtttcatttgccaattcacggattcgcatatagacgactttctcgctattttgggagatgtagttgtataaagaagtttcaagctcgttaaatgaagcaatcatttcgtgtgtgaacatgcagggggattctcctttttatgagaatggtgaatgtacatctaatcgtaacatatcatttttaaaagaaacatagtgttatatttatgtgacaaatcactttttgtgtcattcaaaacaagacgtcagccaatgatttacggcgcaaaacaactgcggatataattcgttcatacgctttatgcttgatctcttcaagggtctctgacaaaagcggccgaaaaaaggaggacaatatgagtatcaaactgatagcggttgatatggacggaacgtttttgaatgatgaaatggcatataataaagagcgttttatgaatcagtatcgtgaattaaaatcgcgggggattaaatttgccgtagcaagcggaaaccaatatgcgcagcttacatccttctttccggaaatcaaaagtgaaatcgctttcgttgctgagaatggcgctttcgtcgtgaatgccggagaagaattattcgcgggtagcatgtctgaaaacactataaaagcagtgatccttgctttagagcagtatgaggtgaaaaacgtcattgtctgcggaaaaaaaagcgcgtatattcatgaaaaggccggtgaagatgaatatctgcatgccagtaagtattattatgtgttaaaaagggtgccgcattttgaaaacatcgatgatgacattttaaaattttccatcagctttcccgccgaacattgttccgcacttctgagccatttgaaaaacgccatcgggtctttcgtcacgcctgtatcaagcgggcacggtgacatagatctgatcataccggggcttcataaagcaagcgggattaagcttctccagaaacaatgggggatgggtgatgaagagtgtgcggccttcggagacagcggcaatgatctggagatggtgtccgccgtgaaatacggggtcgccatggataatgcgcaggcaagcattaaacaggctgcggcgcatatcacgcaatcaaacaatgaagaaggggtcttaaatgcgattgattccatcctcaaatgtgaaaaaccctttgtctgaaaaagacattttaactgcggaggtgctgaacgatgattaaattagtgattacggatttagacggcacatttttaaataatcaaggcgattttgacagaacgttatttgaaaagacaaaacgagtaatggaggaacagcatgtcgctttcgccatctgcaccgggaaacagtgtgaaagggtggaagccttattcggagaagacgcgaaagatttttggattttaggagacagtgccgcacgtatgaaaaagagcggcaagttcgtatatgaatctttgatcagcaataaagccggactgtcaattataggcgctttagaaaaaatcagctgcgggcacaccattatcgcgtgcacaaaaaaaggcgcgatcgtaaaagaaaatctgtctgaaagtgaaatgaaatatgtaaatgcctcttatgcacatgtaacgaaaataactgattttactgagataaaagacgattttatcaagattacggttcatgaccccgacgccaactgtccggaaacgagagaaaagctgcatgaattttttcaccaattatatatcgtagcatcagaggatacctggatggacatatcaaatatcggaatacataaaggatcaacagtacaagaactgcagcgattattaggggtttcggctgatgaaacaatggcgttcggagacggccgcaatgacaaagaattgatggaagcggcatcctacagctttgcggttaagaatgccattgacgaaataaaagatgcggcgcactttgtcatcaaatcaaatgaggaaagcagcgtcatgcacacgattatgagaatattagcgctgcaaaaacaatgatgggctaaaatcaatgcggcatgacttactagggatagaaaaagcgggctatcctcagactttaattcactcctgattttcctaaagtatgttaaaaatgaataaatatctatatttgactcgatggtattggtataatatgtataaaatgaatgaagcggtgtaatatcaagatgaaaaaaatcacttcatatcagacaaaaagtaggaactgcctcgttttgaaattgggaggtgtttgtattagcccgctgttgagccccgcgtatatcattcttatttttcttccggcagcttcttttctgttagggattttaggatatttcatctttaaaaaagtatggatgatggttgttattgtcttcattttgtccttgatattcatgtttattgtaataggtgccgaaccgacatttttcatttgggtggctatgatgacggggagctgttttgtctccggttcaatcactaagacgatatggacttttgcaaagagaaaatattagacagaagaatcctgtttgaacagctatcctttttttgtcgattgaagaaaaagaagtatagaggtatccgttatgttcttatattttgtctgttgttgtcagttcgggctttctgttaaaaatgtctgtctatcgttttgttcttttttaactaaacggagcactataattgaactgcagatacatagaaaaacaaaaaaggataaggaggatttttatgtttcaaactttagaccattttttgaaatcttgggaattcgaagccgatgcgacacaaaaactgctgaatcatctgactgatgaatcacttaaacaagaaatcacttcagaacattggactttaggccgtattgcttggcatactgtcgctgccattcacatcattacctcaaacacagatttaacgtttcacgctccggccgaagattatcctgttcctgcatcggcgcggtttattgctgagagttatcatcaagccagtaatgcatttgtacaggcgttaaaaacgcaatggactgacgatacacttcaagaatgtgtcaactttattggtcagcaattgccaaatggttcacttttgatgtttttaattcaacatcaaaaccatcatcgaggacaaatgactgtccttatgagacaagcaggtttacctgttccgggtatttacggtccggcaaaagaggaatggattaaattcggtttggaagctccgaaataggatattgttgtaagggctcgaaagaatagatgataccaatcgatgttggtatcttttttgttttagtcttagagtgattaaaccggtatccatgacatgcagacgaatcaacagttcaatagatgtaaattaaggtcaataaatgcagaaaggtgattatgatgataactaaaatgacgcgattcaatatgaaagacttcaataaaccaaacgaacctttcgtagtttcagggagaatcatcccttcatttgaggacaatgtttggacatatacagaggagaaatttgctgagccttatgtcaaaaaatatgacgatgaagacattgatgtcagttatattgaagaagaggataaagttgtctttttttattacgcagagaacgactgtgtcggccggagtaagcttcgttctaattggaatggatacgcactgattgaagacattgccgttgcaaaagattatagaaaaaatggtgtcgggacggctttattgcataaagtgattgagtgggcaaaggagaatcatttatgcggtcttatgcttgaaacacaagatattaatgtttcagcttgtcatttttatgccaaaaataactttgtcataggagcggtcgatacaatgctttattccaatttttcaacagcaaatgaaattgcggttttttggtactgtaaattttaaatataacagtatttgatgtttcgtcatttgcgggtgtgtgtcgcaaagcattcaaaacatcggcttgaggatttataataaggtatatcaatcaatgcagggggagttatgtatgaagtgcaaaaaaatgaacagggtccaattaaaagagggaagcgtatcaatggccctataaactgcgtctgccctcattaatggagggaaatttgtgaatacgccttattcacagtcagctttacggcacaaccaagtgttcatttggctttgtgttctgtcatttttcagcgcattaaatgaaatggttttgaacgtatcattacctgatatcgccaacgattttcataaactgccagcgagtgcaaactgggtgaacacggcctttatgttaaccttttccatcggaactgctctgtatggaaagttatcagatcagctggggatcaaaaagctgctcctatttggaattatggtaaatggcttcgggtcgatcatcggatttgtcggacactctgtctttcctgtactcattctggcccgatttattcaaggggctggtgcagccgcattcccggctcttgtgatggttgcagtagtacgctatattccgaaagaaaacaggggtaaagcatttggtctgatcgggtcgctggtggcaatgggggaaggtgccggaccagctattggcggaatgatcgctcattatattcactggtcatatttgctgcttattccgacagcaacagttatcaccgttccattcctgatgaaactgctggaaaaggaagaaagaatcagcgggcgctttgatatggcggggattatattaatgtctgcaggcatcgtattttttctgctgtttacaacgtcatatagaatgtcttttctgatcatcagtattctagctttcctgatatttgtgaaacatattaggaaaactcaagatccctttgttgaccctgcgctggggaaaaatgccttgtttatgatgggcgccctttgcggaggcctgatattcggcactgcagcaggatttgtgtctatggttccttatatgatgaaagatgttcaccatttaagtactgcggcaattggaagcgggattatgtttcccgggacgatgagcgtcatcatcttcggttacattggaggatggcttgttgatcggaaaggttctttatatgtgctgaccattgggattgtattaatgtcttccagctttttaatcgatgcctttttcatagatgcggcaccttggctcatgaccgttatcatcgtttttgtttttggggggctctccttcacaaaaacggttatatctacaattgtgtctggcagtttgaaacaaaaggaagccggcgccggaatgagtctgcttaattttacgagctttttatcagagggaacaggcattgcaattgcaggcggtttattatcgatccgcttgctggatcaaaggctgctgcctgttaatgctgatcattccgcttatttgtacagtaatatgctcattctttttgcaggaatcgttgttatgagctggctggtaaccatgaatgtctataaacgttcgcaaagaaatgactaaaaagggaaaaggatcaaacttgataaaagttttgatccttttttgaggagattccttattccggaagcttttgtcgatcaatgaaaggggagttcactgccaatcgggacttttgagaaagtgtttgaggatattaaaataggccggagagaaagttaatcattctgtttgaaaatgaccatgaagttcgtaagcagtatggttttaacacgcatctggattcccctgacaaagtaaaggtttttggggatttatgttaaaataatagtaagaaccttgtgcagcggacagggagtttcgttgcttcataaggagagggatctatgaaaaataagattcacatactgggagcctccggagtcggaacttcaacattgggagttgcattatcaaagcatttgcctcatacgcatcttgatactgatgattactattggacagataaattcactaaaaaaagagaaatttctgaaaggagagagttgcttgaaaaagacttgacaataaatgagaaatggattctttctggcgcagtgtgcggctggggcgatgatctaaaaagttattttgaccttgtcatcttcttatggattccgcaggatatacggcttgagaggttaaggcatagggaatttcagcgttatggaaacgaagtgttagccggcggcagtaaatatgaacaatcaaaaacatttttagagtgggcttctttatatgataatgccggaatggaagttagaagcaaagctttacacgaatattggatggcagatttatcttgtccattgctaaaaattgaaggagattactcagtaaatgaaagagttgatcgtgtcttggattatctgaattttaattaaactaacggatggagataactgcaaaatccaaaattcaaagacagttccggccattttaacggagctgtttttttataccgctttctgtttctctgttgtgaagtgatttattttcggcagcatcctacaatagagaagtgatttgttcttcgtgaggaagtttttggttaagttgcaagaaacggaactccaatgaatagatacaccctgaaacctgtccagccagcgtttaagctggttaccattgagtgaaaagcaattgccgccggcaaagacaatacctggaatgaaaagtattgcagggaaagctaatttggtcatttaccgtgaaaatacggaaggcttttacgctggccgaaatatgtatggcaggtaaccctggaagtggctgtattgactggagttttcactaaaaaggcgattacacgtattgcgcatgcagcctttcaaagtgcgatggaacgccgtaagaaggttacatggctcgggactctttttgaatacgtgccgagaaatgccggaacaataccctgaagtggatgattatcatattgatgcaatgacggtacatttagttcgtcggcagcttggggcttgcactgtcaattaatacaaatgggaaagcaggcaatggcctaggctgctcacggttcggcacctgacattgcagggaaaatattgcgaatcctatcggtattatactttcaactgctatgttgtttgaatgctcagtacacagtatcgtgataaaaaactgaaagaagcagcggaattaatagaaaactcacttcgggaaaccgtgaaggcaggaatcaaaatgggagatcttagcggtcaatcatcaacgtcagactttgcagaagcaattgcagaaaggatcggatgttaaggcggaaaataagaggtgagaagcagatcatcaaaacgcaataggacacctcaatttagattttcagtaagaacggctctgctcattaaaaaactcaattcgtagattaatggcatcaataatgctgcagatcgggttagtaacttaaagaggaagggatgagaccccttccttaacaccttcaattcctctaatttcattgtaagatatattacttttttgaaatgggtatccaaatttcacttttaaaagatggcgatgttacatctttatgctcattccacaggatttctgggccttcaatttgttcataatgtgacgatggaaaccattcagaataaatccgcccccatacttcctgcagtgcatccggaaatgatccggctgcttcgaatacagcccacgttgaggcagggacttcaagctgtgataggtgatttgggcaatgtttcgttgtggctgcgccaatatagtgatcaagctcaccgttttcctctgtccggccttcagaaaagttcgtggatgcactgatgagtcctacaggcgctacattagaaagctcttttagttgtttgattgctgtttcatctaaactttcccacatcgatgcaatgtcaggattcacgcctttgaataaaatagggactctttttttaatgccgacgatgcgaaatgcctttttttcttcaatgcgatagttcatttcatttcctcctttgattgataactggaaggtcattcgcggataagctttaagtgaatggccattatgtttagctgctgatgggcttatgccatgcagattttgaaatgctcgtgcaaaagaatctggtgagtgataaccgtattttattgcaagatcaatcacctttacgctgctgtctttaagttcaaaagctgcaagagtaagacgtcgtcgacgaatatattccgataatgaaatacctgtaaggaaggaaaacatccttttaaaatgatattcagagcagaaagcaagccttgctgcttctttgaaatcaatatcgttcgtgaggttttcttcaatatacgttaatgcgctattcatccttttaagcgaatccatttatttgacctcctttaacaaaagaataacaggagcgaaatgtatctgcccgacatttcgtgcacagttttgcaggataacttatatgtaataaattaagtgattcacctgtatttgtacagataaagaaaaccacctaataactgcttgggtttcataagatgaaagaagttatcattgttttatattgaaaagaaaacagaaaaagacggagttttcttgttggaggggtttactatcaatcaattgaaagttgcttacgcagaggtagataaaatgtcgagaacggtgttcaccttcactgcttgttcaattagaggaagtgattcttccttaagggagatcactttttcttattcgacgaaagcagcagtttagcggaagatggagaaaaatcagttgacttacttgaatactaaataggtgtaaaaagtggttattcatacggattgaaaaagaagaacacgcagcagattcacttgctcttgtttggggcaagtgttgacaaccccattactggtttaattaaaagaaggggtataaaacctgtatcaatggtgttactcgatatctgcgacacaggttttatatgcaggtaactaatattcctatatatgtaacattgcattttttattatgcaatagttcactctatttctgctttcaatttttcgaaccactctaaattaaccaagtgatgtgaacgggaattttcattcatgcggcgaaagtaattgattgtgccgggaatttcttgagtgatggacaggtattcgtcaaggagctcgattcgagttttagtctgatcgatttgtgattggatcagatccagtaatttatttttgtcgaattcatcggcaaagagtaacgccccataaaattgcaggttcacatattccgatttagtgccgtatttgatcattaatttctcgaattctgcccttcccgattctgtgacgttaaagttacggatttcacgcccgctggttgagggtttctgctgaatctgttcaatcaaacacttttcttcaagttgctgcagattgtaataaaatgaacctttcgtgaagttaacgatgtacttgtaatgacgtttttccattaaggccagaagttcatagccgtgagctccggggttttggatgagcaagccaaggataagtaagggaatcatggtttcatcaccttcgccatccgcgcctcaaattccgcgtacgtgattttacccgaagccaaatccatactatgaaggtaaatctgttctgttttagaatagtcaccattcactttcagtgattgctcctctcccgaaatgggtttcaggatatggtgctttttcgaaaaagcctcgaaatagcgataaccgaatttgcgttgtgaagctgcgtctaaatgaatgccatcaggattcgcagtcaaacctgccgcagtaacaaaataacaattctgttgttcattagcaaaacgcagcaattgttcattaacctgtcgaaattcagtcgcgtgctgtccaaaaccagtcttcccaagaaagtcaccaagccctccaataatcaacggtagctcatctaattccaactcgtttcttagcgtctcgatgataagagttaatttctcgtaataagtttcatgcagcgaacgataactgtcactctcaccttgatgccaaaggattccacaaatttgactggatcggagggcgaagcgggcttcggacaaagcatgctgaaaaaggatgccttccggatgccagtcattcaatgaactgccgccttccgcacacgggatcaagccaatttcttcatcgggatgagctttcgaccatgcatctgcaaaagatgcggccaggccaacgcctgaaaccggacggtcgtaattaatcggctctgtcatcatctgccactgtccattgcgcagcattttaattttttcattatagatagggtctacttcattcaaaaatccacggcccgccatattcgactgccccaacattaaaaaagactttatcatctaatttttcacttctttacatcaatattttagtctaattagactatagtccattcagcttgtcttgtaaagtttcaactaggttttatttttattattagtatgtatgaaaaacaaactaacattgaaaatttggtggatgtatttgagaattagcaagttcttttgctttaggtcttgataaacaatgaaaaaacaacaaaaaccctgtcatgtaagggttcctatgaggttcaaaatcatttttcataggaaatacattcaatgatgggggtgtagcccaaatgaaatggattgttaaaaagagagggctatgttgaaggggttaaatatcaataaaaaattattaaaaaggttaacgattgtaccaattctattcatttgttatgttttatttttaaatcctgaagttatacttgaagagcaatgtcctaaaatgcagaaaaagccgggatgtcagatccggcttttcgctcactttcccttcttcttccgcttctccttctccgcccgataaaactcatgaaacatcttcatcaatgcgcgtttttcaatccgcgacacataactccttgaaatgccgagctcctttgcgatctcgcgctgcgttttttctttttttaaatcaagcccgaagcggccgacgatgacttctttttcgcggtcgtctaaaatatcgatatattttttgaccttttcaagttccatgttgagctgaatggtgtcgatcacatcttcgctttccgacttgaggacatcgatcaggcttatttcattcccttctttatcctggccgatcggatcatgaagggagacgtcttttttcgtttttttcaatgcgcgcagatgcattaaaatctcattctcaatacatcgtgcggcatatgtggcaagcttcgtgccttttccggctgagtagctttcaattcctttaatcagcccgattgtaccgatggagatcagatcttccgcgtcctctcccgtgttttcgaattttttcacaatatgggcgactaaacggagattatgttcgatcagcatgttgcgggcgtgttcatctccttcagccataaggtctaagtattttttctcctcattatttgagagcggttgtggaaaggcattatttttcacgtatgatactaagaacacaagttctttcacaataaacccgagcgctgcaaaaacacctgtcaccgtcctcacctccacaaagttatgtaggcaatcgcctatatgtaactgtatgtggaggtagggctgtttgtgtctgtacagggaaattaatcaaaatcgggttttatttcttacagcctcttgatttttgatgattgagcctgtatattttttaaaaaagtaagggtgaaaacaatataaccgaaaagcgctgaagagacgagtagacagatatcattcatgacagagagctccgggagctgtgaaggagtatgaatggatgtgttgaaacaaacctcttagcttcgcatcggaatcatgcaacccgacgatgatgcggcggatactcctgttaccgagtaagctttgtacccggcaaggccggcaccaaaccgaattgaggtggcatagcgggctgtttcccgtcctcaagactttattgtcttgagggcgttttttatttctaagggagggataagatgaaaaacctgaagtcttggcggtacccgttgcttctgttaaccggaatcgggatagcaaatattggtgaatggatctattttttgtctcttaatcttattgtcttaaaagaaacggggtctgcttttgcggtttccatcctttatttaatcaggcctgcggctgttttgatgacaaatggctgggcgggcagcatcatcgaccggtgtaacaaacggaatatgatgatgtcgcttgatttcacccgggctgcattcattgccgttctgccgctgatggttactgcacggtctttattttccgtttattgtatcgtgtttttgattcatatggccaatgcgatgtttcgtccgtgttccatggcgtatgtgacgatgcttatcccggctgaaaggagaaaacgattcaattcactaagggctttgtcggaatcaggggcttttctcctcgggccggctgcggccggactgctttttatcgccggcacgccgatttttgcgatttgggtgaatgcggcggctttagtgctgtccggtttcatcacgatgatgctgccgaaccttgaaaatgagcctcacgtacattctcccagacagaagctttctttggcagtgtgcaaagaagattggaagctcgtctatcgcttcagccgaacggcgcgaaacgtcatgatcatttattttttattcagtctggtcatgaccgttatgccatccgcgcttgattcgcttgaagccgcttttgcaaaagaagttcttcagctgactgatgccgattatggttttctcgtcagtgtctcaggggcaggcattattgcgggagcgcttgtcaatgtgttctttaataaaaaaatgccggcttctttattgatgggaatgggctctttattcacagcggccggatatatgatttatgcgttttctgacgttttttggacggctgctttcggatttttccttctcgctttttttctggcgtttgccaatacaggctttctgacgttttatcaaaagaatgttccggtggacatcatggggagagtggggagcttttattcattagtcgaagccgtcttcattatagtagtaacggcggttttcggagcggcttctgtcagttcttccgtccgcggcatcgtcatcgcaggcgctgctgttatgctggcgttggcagccgttttatgctcgttcttatttgcggccgcaagaaggaggactcctgatgtatttcaagcggatcaatttaaacaaacataaagagacggccgtttcgtttggtgaggattcgtttttcgtcagctttggcacggcggatcattttaatagggatgaatatctcaggtggctgtcatcccaaatcaaatgctttcccgacggttttatgctgctttttcataacggacagccgatcggacagctagaagcttccatcaaattttaccgcagccaaaaaatcggttatgtgcacctttactatatgactgagaagcagaggggaagggggtgcggaacgaaaccgcatcaatacgcgaatcagtttttcagagcgaacggtgtttcggaatatcacctgagagtttcgccgagcaatgaagcggctctgtcattttacagaaagaaaaacatggaagtgatcggttcagaatgtaacggaaaagttctcagaatgagaggagccgtaccgccggaatagggggcggtacgcgcttcattttttcgttgtttttaaaaggccgggaaacttcttataaatgaccgccattaagacgagcatatacattccgtaaatcccgaaagacagcagtttgttgcttgtaaatgaagcgcctgcgacggtcacgatcacaatgttcggaattttgccgagcaccgacgcagaaaaaaagatcggccatcggatattactcagcccgcagacggtattcatggcaagcgacggtataatcggaatcagccgcccgaaaagcaccgccgtaaacgcgtgctgatgaaatgaatcttcatattgggccgctgccgggtaagccagcagcttttttctggcccagtctctgaatccgtaccgaacgagaaaaaacaacgccattgttccgagcatcgcgcctgacaatgtaatccacaccccgtttacaatcccgaaaaccgctccgtttaaggccgcgataatggcgaatggaacaatcggaaaaaatacgtcagctgcgaccagaaggatactcataagcacggcgtacatgccgcccgcgcgaatcatgctgagccagacgtctttttgcaaaaagccgatcatcacgacagcaatgatgacggcaagactgaatcccttttttatcatctgcacgttcacctcttttcaattagtatacagcacaaatctatctccttctattaaaataagctgtccgataagcgtatttgatttatcagcatttgccgtttgatgagaaacggctgcacccggatttggacaaaaacaagcgggtgatgtgcatcatttgatgcagagaatgattttttataaaaggggacacgttaacagtagtgtttactggaggtgtaaacgttgagatgctttcatctgatcatcatgatatgcgtcctcacgagtctcactgccgtgtccgccgatgcgaaatctttaaaaagaagtgacatggagaaaacgggaaacgtgtactgggataaaaggtctgaaaaaaagaaactatctttaaccttcgatgacggcccccatcctgtctatacggaggctgtgttagacgtgctgaaacagcacaatgttaaagcaacctttttttgtgtcgggagccgtatagacaaataccccataacggcaaaacgcatcgttgaagaagggcatgaaatcggcaaccatacgatgaaccatgtttattttcaccgactgaaacgcaaagacattttacaagagcttcacagctcagcgcatcatatcacatcgctacagccggaaggggacaagttattccgcccgccgggagggtcgctgaatcatacggctttcaaaagcatcttaaaagagggctatcatatcatcatgtggtcatggaaccaagatccgagggactggaaaaggccagggaaaggaaaaatcgtcaggcacgttgtttcacatgccagagatggagatatcgttcttctgcatgacggcggaggaaaccggcgccagacggttgaggctttgaaagaaatcattccaaagctgaaaaagcagggctacacgtttgttaaggtttcggatttgatcggacaggattccggtccttttcatatccagtaaagagagcgccgcgttgaaagccgccaaagagatgtgtaccataggaggtaaggtttggggggagagaaaatgaagtttgctgttctttttattacgataatctgtctgttatcaggatgcgccgcgggcaaagaaaaaagtgttgtcgcgttcggcgacagcaatacgcgcggttccaactgggattatcgtgattatccgaaggcgcagcagtgggtaaacattttaaaaacagcggaacgcggccgtcttacggttataaatgcgggaataggcggccagacgactgaggatgcgcgcctgcgttttcaaagcgacgtgctggaccgtaagccccaatatttatttatcatgttcggaacaaatgatgcgggcattttgacgggcgatcagccgcgggtatcaaagaaacggtttaaagaaaacctgacttatttcataaacgaaagcagaaatcacggcataaagccgattttaatgacgtgcatcccggttatagaaggaaacggaacgcatcatctctattactattcgagatataaagcctcagcctttaaagaaaaaggcggcgcgagaaaatggcataattcctataacggcgttacgaggcaggttgcagctgagttgaaagtgccgctggtggataactggaaacactttatacgcgcggacggcggcaaagatacagaccgggcgctgattcaatccggactgatagatccctccggaaatcatatgacgccaaaaggcgccagaatcttaattgaaggcataaaaaatgggcgggttttggaacgctgacgccgtcagctgcctaaaccgttttgcttctgcttcataggctgtagaaaaaacatctttttggaggcgattgctatgaaccgcggtttccctccgcaatatcctgtatgcccgcctcctcgggtgaatgcggggtactggtacgcattttttgttgtgctgctcgtcgtcattctcgtcctgggcggtctgtattggttcaatatatagcagctgtcctcttaaacacctctattttaggggtgttttttgttgaaagtggtagtaatgcgcataaccgaagtgatataatatcagtcatctgagtaaaaaaaggaaattcgcccgggaacttttttctgtttaagaagaaacggaaataatgtgtccgagcgatcttcttttaatttcgctttcaattaactcgataaattcacggctcaaattcatttcattggctttgaaataagattctattagtaattcatcagaaagctttctcatgccggggacccaattaatgggagtggcacctccttacaattgtaatcaatcatcagacgcaagcatatgatggaaggttgcgtttcaatcatggtgaggttatctttaatctaccatgaaatacaaataagaacaatcgttctgttatccacactcgtaagtggataacctgttagtatcttgtttataatctggataaatccggatgtaataagagtggataatgtgtgtaattttatccacaactggtgaagaaacccaatttttgtcgaaatttttttactgagtccgactttgtttttaaatctgacaggtttcgacatatagatggtagaaagaaaaggaagggtgcgggttttgttaaaaaagttttttttacctgacgaatttgtgaaaaatatatttcatatcacaccggaaaagctcaaagaacgcaatgtgaaagggattattacagaccttgacaacacgcttgtggagtgggacagaccgagtgcgacacctcgattaatcgagtggtttgaagaaatgaaggagcacggcattaaagtcacgatcgtctccaataataatgaacgaagagtgaaattattctcggagccgcttggcataccgtttatttataaggcaagaaaaccgatgggacgcgcctttaaaagagccgtcagcagcatggatctgaaaaaagaagactgtgtggtcatcggcgatcagctgcttactgatgttctcggcggaaacagaaacgggtatcatacgatcctcgtcgtgcctgtcgcttcctctgacggagtcatgacgcgctttaaccgccggattgaacggagaatattgagttctttgaaacgtaaaggccatattcagtgggaggattagaaatggaaaaggttgtttgcatcggctgcggagtaacgatccagaccgaggataaacaaggtctcggatacgcgccaaaggcatcgctcacgaaagagaatgtcatctgccagcgctgcttcagactgaaaaattacaatgaaattcaagatgtttcattaacggatgatgactttttaaatatcttgcacacaatcggcgatactgactctcttattgtcaaagtcgttgatatttttgattttaacggaagctggataaacgggctgaaccgctttgtcggcggtaatccgatcattcttgtcggtaataaggccgatatcctgccgaaatccgtaaaacgggaacggctcgttcaatggatgaaacgcgaagcgaaagaatacggcttaaaaccccttgatgtctttttaatcagcgcttcccgcggacaagggatgaaggaagtcattgacgccattgaacattaccgcgaagggcgcgatgtgtatgtggtgggctgtaccaatgtcggcaaatccacatttatcaaccggattattaaagaggtctcaggggaagagaatattattaccacctctcaatttccgggcacgacgcttgacgcgattgaaatcccgctcgatgacggatctgcgctttatgatacgccgggaatcattaaccatcaccagatggcgcattacgtggacaagcgtgacttaaaggtgctgacaccgaaaaaagaactgaagccgcgcacttttcagctgaatgaaaaacaaacgctttatttcggcgggcttgcccggtttgactatgtatcaggcgataaaacggcgtttgtctgctatatgccgaatgaattgatgattcacagaacaaagcttgaaaatgctgatgccttatacgaaaagcatgcgggagaactgcttaccccgcccggaaaagatcatttggatgaatttccggagcttacgccccacacgtttacgattaaagaaggaaagacggatatcgttttttccggtctcggctgggtcacggtgcagcaagaagataaaaaaataacggcatacgctccgaaaggcgtacacgtatttgtccgccgttcattaatatagagagaaggggagagggagcatgaaacaattgtacggagtaatcggaaatccgatcgggcattcaatgtcacccgatattcataacgcggctttgcaagataagaacatcaacgggcagtattttgcgtttcaggtggaacctcatcatctcaaggacgccgttaacggaatcaaggcgcttggcatctgcggagtgaacgtcacagtcccgcataaagtcgcgatcatggagcatctggatgaaatacatgaaagcgcgaaagtacttggggccgtaaataccgtcaaaagagagggagacaggctcatcgggtataatactgacggagatgggttttataaatccttagtcaaagtattggacaaaccgatatcagagctctctatcctcatgattggggcgggaggagcggcaagagcgatttttacgacgatcgtccgcggagagccgaaacaatttgacgtttgcaaccgcacgccggaaaaagcggaaagcctgattgcggctgctccctcttttcagcagaaacgcgcccttactttaaaagaagctgaaaatcagcttgaacaatatgacgtcattattcatacaacatctgtcggcatgtatccgaaaacggatgccgtgccgctctcattggaacgggccaaaacgggcgccatcgtttgtgatatcgtatacaacccgattcaaacggcgttcttaaaagaagctgaaaaaagaggtttaacaacccttgacggtgtcggcatgtttgtggaacaggccgcactgtctttcaagctgtggacggaacaagagcctgacagcggcttaatgagagcgattgttgaaggaaaactaggaggaacacaatgttaacaggaaaacaaaaacggtttttgcgttcaaaagcgcatcatttaacgcctatttttcaagtgggaaaaggcggagtcaacgaaaacatggtgaaacagattgccgaggctttagaagcaagagagctgattaaagtcagcgtgcttcaaaactgcgaagacgataaaaatgatgtcgcagaagcccttgtgaaaggcacccgctcacaattggtgcagacgatcggaaatacgatcgtattgtataaggaatcaaaggaaaataaacaaatcgagcttccgtaaggtggttgacatgaagaaaatcggaatattcgggggcacatttgaccctccgcacaacggacatcttctgatggctaatgaagtccttcatcaggcggagctcgatgagatttggtttatgcccaataaaatccctccgcataagcagaatgaagactttacagacagccggcaccgggtggagatgctgaagcttgccatcagctctaattccggctttaagcttgagcttgcggaaatggaccggaaaggcccttcttatacctatgataccgtccgtttactgaaggagcggcacccgaacgacaagcttttctttattatcggggcggatatgattgaatatctgccgaaatggtacaaactggacaaactgctcacgctcattcaatttatcggagtgcggcgcccggggtatcatattgagaccccgtacccgctgctttttgccgacgttccggaatttgacgtttcgtcaacgatgctgagagaacgtctcaaagcaaaaaagccgacgcaatacttaatgccggataaagtgaggcagtatatagaggagaatgatttatatgaatcgtgaggaagcacttgcctgcgtcaaagagcagctgaccgagcatcgctacatccacacaatcggcgtgacagatacggcggttattctcgcaggccggttcggagcagacccgaaaaaagcggaaatggcggctatttttcatgattatgcgaaattccggccgaaagaagaaatgaagcagatcatcgtgcgggaaaaaatgccggctgagctcttggattacaatgccgagctgtggcatgcccctgtgggagcgtatttggctgagaaagaagcggggatcactgatcctgagatcttggatgcaatccgttatcacacgtcagggcgtcccggaatgacccttttagacaaagtcatttacgttgcggattacattgaacccggacgccatttccccggagtggaagaggtgcgccgtctggcggaaacggatctgaacgaagcgctcatacaagcgatgaaaaatacaatgatatttctgatgaaaaaaaaccagccggtctttccggagacgtttgcaacctataactggctggtgtctcaaaattgacaggaggaatatggaaatgaatcaagcttccgtattaaaaatcgcggcaaaagcatgcgacgataaacgtgcagaagatattttagcgctggacatggaaggaatctcacttatagcggattactttttaatctgccacgggaattctgataagcaggttcaggcaattgcgcgtgaaattaaagatcaggcagaagaaaacggcattgatgtcaaaaagatggaagggtttgatgaggcccgctggattttagttgatctcggcgacgtcattgtccacgttttccataaagatgaaagaagctactacaatcttgaaaagctatggggcgacgcgccgctcgcagagcttgaactcggcttgaactcatgatttaccaaggcttcgccggcgtatatgacgagttaatgtcacatgcgccgtatgatgaatgggcgggctggatcgaagcgtctcttccggaaaagggaagggtgcttgatcttgcctgcggaaccggagaaatatccatcaggcttgctgaaaaaggctgcgaagtcacggggattgatttgagtgaagatatgctgagctgtgcccagcagaaaaaaacgggaaagccgattctttttctccaacaggatatgagagagctttccggttttgaagaacagtttgatgccgttgtcatctgctgtgattccctaaattacttaaaaacgaaaagtgatgtcttaagcaccttcaaaagtgtttttcaagttttgaaggagggcggcctgcttctgtttgacgtccattctccatttaaaatgacggagctttttccggacagcacccatgcggatcaggatgagcagatcagctatatctggcaaagctttgccggcgatgaagagctttctgtcatccatgatatgtcctttttcgtatggaacggacaatcttatgaccgttatgacgagacgcatgagcaaaaaacattttacattgaagaatatgaacaaatgcttgcagagaccggatttgaactgaagaaggtgacggctgattttacagaccggcctccttcaacagagtctgaacgtcttttctttacggcaggcaaaccaaaaaccatcgtttaaacggaacgatggtttttaaaatgcattttttgcgattggcgcgataaagcactttatggcatactcagttacacgtgaaattgcttcttcactaacgatatatcttcatcgtatttgtcatgtgtacgctgaaagacacggttgaacatatcctgaacaccgctttcgagagccttcagtccttccccggtgacgccgccttttacgcatactttttcctgcaaggcgggaagcgtgtaatgccctgtttccagaagctttccgagaccgacaagcatctccgtcgacataatcacggcttcttctttggtgatgtccgtttcttccactgccgcgtcaataaagcgctgaacgagataactcataaaagcgggcccgcagctgacaatgtctgacgccgctcttgtaatgccgctgctgatttccacaggttttgaaatatgagtgaacagcgtttgaatatccgcttttgcagactcgctgcagcttttgccgaacgtaacaagcgagacgccggccaaggcgcggttcgtaatgctcggaatgacgcgggccgtctgacacggaaccgtatgttcaatctgatccgtctgaacggggctggtaatggagattaaaatgtgatctttccgtaaatgcggtgtgagttttttcagcaaaggatatatatccagcggttttacacaaatgaatattatttcattatcctgtacgagcttttcctgatcctcggtgacatggatgccgctgaaacgttcttctagttttaatgctttttcgattgttctgtttgtgatggtgatatgtgagggatcggcagcgtttgattcgataaacgattcaatcaggatcgttcccatgtttccggtgccgataaagcctattttcaatgaattcccctcctttttcccttaatcctctaaaccttatgcggggaggcaatgcaatatgacgaaagcgatgatgacggagcggctgcggcggaacctgaaaattctgggcgcttgtcttgcggcaggggcggtttttatctgtatttggctgtttcgttctgaaaaggaagagccggtcaaacagcagtccgtgctcggccaaacagcctcagcatccgtcgcggacaaaaaagacaccgcagccgataagattatgattgatgtgaaaggtgcggtccgaaatcccggcgtgtatgaaatgaaagcgggagacagggtgacgcaagccattgaaaaagccggcggcctgaagaaaaaggcggatgaattgaatgttaatttagcagagcagctgcaggacgggacgattgtttatattccgagtgaaggcgaagaggagaatcgcccgaaaacagcggcgggtgaaaaggagaatgcagctgtcaatatcaatacggcatctctggacgaacttcaggcgatttctggggtggggcagaaaaaagcggaagcgattatcgcctaccgagaagaaaacggacagtttcagactgctgaagatttgatgaatgtatcaggctttggagagaagtcatttgagcggataaaaacttccattacggtaaagtgaattgacggttttgcttaaatctatgtaaacttagaaaagcaacaagactttttggagggaacacttgtggaacgaatctcatggaatcaatattttatggcgcaaagccatttgctggcgctgagaagcacatgtccgagactgtcagtcggggcaaccgtagtcagagacaagcggatgattgccggcggatacaacggctcaattgccggcggcgtccattgcgctgatgaaggatgccttttaatagataatcattgccagaggaccatacatgcagagatgaatgcgattctgcaatgttctaagttcggtgttccgacggagggcgccgaaatttatgtgacgcattatccttgtattcaatgctgcaaatcaattatccaggcaggcatcaaaacggtctattatgccgaagattacaaaacacagccttatgcaaaagagctgttcagccaagccggagtcaaggtggagcaggtcgaacttgatgagatgatcatcgatctgaaaaaccgtgaaaaattgtcttttgtagcaggtctgattcagcaattatctgatgcgggggttaaggcagatgaactgaaaaaaattcatgaacaggccaatgagctgtttaccagttacgtataaatgaaatataaataccttcttctgcctctggcggcggtttctgcaactgcgggaattgccgccgctcatgtcttctgggttctgctcctttttcttctgtatcttctctttattattgtaaaaacaaagcagtatgctccggttatcgtctgcctcgtttctttttgtctttatttctttctttatacggtttgtgacgctgcgaatgtaacgcgctatcaggccggcagttatactgaacaggccgtcatcactaatattccgaaggttgacggagcgaaaatgtcagctgttatccgtacacatgacaaggaaaaatgggcggcttcgtacaaaatccgttctcttgaggaaaaaagactcattgaacagcttgaaccggggatgcgctgcacgtttacaggctctctggaacagcctgcacatgcgacggttcccggaggttttgattataaggaatatctttactctcagcagattcactggttattttccgtgacttccattgagcagtgtgaaaaatccaaacagccgctgtttaaactgctgaacatcagaaaaaatttgatttcgatcattcggaatcacgtgcctgaatcttccgccggaattgttgaagcgctgaccttaggtgaaagattttctatagaggacgatatactgagtgcgtatcaaaatttgggagtcgttcatttaatggcgatttccggaatgcatgtcggtcttattacggcgggattattttatgctctgatcagaatcgggctgacaagagaaaaggcgggaattttgctgctgctgtttttgccggtgtatacgctgctgagcggtgccgccccatccgtattgcgcgcatccctcatgctggggttttatatcgccggaactcttgttaaacgcggcattcattcctctgctgcattgtccctgtcttatctgctgcttctgctgtttaatccttacttcctttggcaggcgggcttccagctttcctttgcggtaagcgcctctttaattctgtcatcctccattttaaagaaagcagggaaaagcagacttgccgggcttgcgatggcttcattgattgcagagctcagctcacttccgtttcttctctatcattttcagcagatttcacttgtcagttttccgatgaatatggtgatggtgccattttatacgttatttgtcattccggtttctgtcatcggtttccttcttcttttactctcaaggcaggtgggagaatgtttgtttgatatgtttgaccttgtgatgaagcctgtgcatgatttcattacatatgcggcatccgttgatttatttactatgattgtgtcaaagcctgactttctttcccttctgctgcttgcggtttccgtttttacgctttttgcggctttggaaaagggaggttttttaaaactcaggaagtcggctctttttttctgcgcggttttggcttatttaatatgccgtccgtatttcagtccatggggagaagcggatatgcttgatatcgggcagggagactcactgtttataagcgcgccgcaccgcaaagggaccgtaatggttgatacagggggagtgattgcttatcccggagaatcatggaaagaaaaacgtcacccgtattctatcggcgagaaggttttgattccatttttaaacggaaaaggggtgaaaaagctggatgcactgattttaacccatgcggatcaagatcacatcggggaagccggagtgttaatcaaaaatcatagagtcaaacggttaattgtccccgtaggattcgtaaaagaaccgaaagatcagaacatattaaatatggcgaaagaaaataacattcccgttgccgaagcaaagcggggcgacaccattacagccggtgatcttcagtttcaggtgctgtctccggagtcgtctgacagaaggagtaaaaatgattcgtcactggtgctttggacggtttttggcggagtgagctggcttttgacgggagatttagaatcggacggcgaaacagaagtgctgaaaacgtatccgaatctgaaggctgatatattgaaggcgggtcatcacggcagcaaaagctcaacgagtgaagcctttttgaagcagcttcagccggaagcagcgctgatttcagcaggaaaagagaatcgataccatcatccgcatgaagaagtgctggatcgtttgaaggcgtactctgtaaatgtgcttcgcaccgatatcagcggaacgattcaatacagatttaaaaaaggcgccggaacgttttccgtcttccctccatatgatatagaagaaaccagggcgcaagaagtaaaaaagactgccgattgacagcagcccggaatgcggctaagagccgataagatggatggctgttgccatcacgaacaaaaaggcgaaaaatccgaaggacacgacaaaaccgacagctgagtcaacagcatcatttcgtttgctttgaacgtttttttcaaaatcattcaatttcatccctcctgacttccctaagtatactggaattgttttgaaaaatctagaagtgatggtaacgttttctgttcttgtgattatcgcctttttacaagcagacccgggagcttgtgaatcaggcgtttattataaatgaggaagctgtccttaaagcttcctctttactaattgccgaactcaatttaggatagaaggggatcaagaaagagaggaagtcatacgatcatggtatttgatgtttggaaagccctgaaaaaaggggatgtccgctccgtttattgtttatacggaaaagaaacgtatctgctccaagaaactgtcagccggatcagacaagctgtcgttgatgaggagacaaaggattttaacctgtctgtttttgatcttgaagaagatccgcttgaccaggccgtaaccgatgcggaaacgtttccgtttatgggggagaagcggctggtcatcgtaaaaaatccgtcttttttaacaggggaaaaaaagaaagaaaaaatagagcataatacagccgctctggagacttatctgaaggagcctgcaccttatacggtctttgtgattgtggctccgtacgagaagctggacgaacggaaaaagctgacgaaagcgctgaagcaaaaagcccttatgattgaagctaaggagctgaatgcaaaggagacgactgattttacgattaatctggcgaaatccgaaaataaaacgatggatacagaagctgccgagcatttggttctgcttgcaaacggtcatctgtcttccatatatcaggaaatacaaaaactctccgcctacaccggtgacagacatgagatcacgcttgaagatgtccgggagcttgtcgcaagaagtttggagcagaatatttttgagctgatcaacaaaatcgtgaaccgaaaacggacggaaagtcttcaaatattttatgatcttttaaaacaaaacgaagaaccgatcaaaattatggcgctgatcgccaaccaattccgtctgattatgcagacgaagtattttgcgggacaaggatacggccaaaagcaaatcgcttccaacttaaaggtgcaccccttccgggtaaagttggcgatggatcaggcgaggcttttttcagaagaagagctgcggcgtattatagaaagactcgcagtgatggactatgaaatgaaaacggggaaaaaggacaagcagctcttgctggagctctttctccttgagcttctccgcactgaatgaaaaaaacgatccccgttaaagggatcgtttttgtattatgcagaaagtccgttcacttgtttcgcaagtctagatttgtatcgagctgcggcatttttgtgtacaagacctgttttcactgctttatcaatgcgtttcgctgcttcagaaagagcagttttcgctttatccgcttcgttgttagcaacagaagcttcaacttgtttgattgcagtacgcatagcagatttgattgtcgcgttatgagcgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacagaactttagattgcaatataaatgtaaagtatttttcgttgatgggtaaattcgcatgattcgttttgtaaatggccacactatgtaccacgatgattgaaggaggtcttccctgtgaaaaacaacgaactggatgtcaatcaatttctgatacggacggatttagcggtagaaacgaaacaggcggtaaaagacggacaagccggtcagaaaaaagaaataaacgggtttattgaaaaagaacgcgacaagggcggcattaaagtcagaaccgtcgatattaccaaagaaggcgccgagctatcggggaaaaagcagggacgctatgtcacgatcgaggctcaaggggtccgggaacacgactctgacatgcaggaaaaagtaacggaagtgtttgccgaggaattttccgcctatctgtcggcattaaagattccaaaggatgcaagctgtttgatcgtcggtctgggcaactggaatgtgacgccggatgcgctcggccctctcgtgaccgaaaaccttcttgtgacaaggcatctgttcaggcttcagccggaaaacgtgcaggaagggtacaggccggtcagcgcgcttgctcccggtgtgatgggattaacgggaattgaaacgagcgatattattcaaggtgtgatcaaagaatcaaagccggattttgtgatcgcggtagacgctcttgcggcaagagccgttgaaagggtgaacacgaccatccaattttctgatactggcattcacccgggatcaggcgtcggcaataagagaaaagaattaagcaaggaaacgctcggcattcccgtcatcgcaatcggggtaccgactgttgttgacgcggttacgatcgcaagcgatacggtggattatatattaaaacatttcggaagagagatgaaagatgacagcccgtcaagatctctggtgcccgccggaatgaacttcggcaaaaagaaggtgctgacagacgaagaccttccgggagaaaaagaacgccaatcctttctcggtattgtcggcacgctggacgaaaacgaaaaacgccagctgattcacgaagtgctttctccgctcggccataatctgatggtcacgccgaaggagattgacacctttattgatgatatggcgaacgtacttgcaaacgggttaaacaccgcccttcatgaaaaagtgtcacaagataacaaaggttcttataatcattaaaatgagttctacctcctctagcttgttcatagagtaattactagacaagcgctggagggattcaaatcatgagaaaaaaacgcagaaaccgtcaaattgtcgttgcagtaaacggtggaaatgcgctcaagggcatgtttttgtttatgacaagccttatcgttattttcgtattatcgggtgtgctcacatcgcttcgccctgaactgaggctttcttcggattctcttcacgggattgccggagaacttccgggtgacgcgtttgcacacctcctcggcatggaaaatcattatttcgcctcagagcttcctgaaaaagactcttttcagctgtcccggctttccttaaaactggcgacaagcattaatatggaagacccgcggagtttcttgggacgtgagctgccgggatttgcccaatacgatacggagatccttctggcggggcaggggacggattatacgaatatgccggctgaatctccgccgccgtcaaaggtgatggaaaaagaaaaagaagtgaacctggcagaaatcgaaaacaaaacgaaaaaagaagaaacggcgccgccgaaacattcaacaggcagcaaaaaagtcgtttttatttaccacactcataatactgaatcctatcttcctctgttaaagggggaaacaaatccggataacgcccgccattcgaaggccaatgtcacacttgtcggagatatgttcggaaaagcgcttgaagcgcaaggtgtaggagcgaccgtagataaaaccgacattcaggcccgtctgaacaaagacggtttaaattatgcgcgaagctacgacgaatcaaggccggtcgtaaaaagcgcgctcgccaaaaataaaaacctgcaatataccatagacattcaccgggattcccgccgcaagaaaaatacgacagccgacatcaaaggaaaaagctatgccagagtcgccatcgtcgtcggcaaaaaaagcgctaattttgaagaaaactataaactcgcaagtgaacttcataagctcatggagaaaaaataccccggcttaagcgtcggtgttttatcaaaaggctctccgggagataatggagtatacaaccaggatttaaacgaccggtcgcttctgctggaattcgggggcgtggataacaatcttgaagaactgaggcgtgcatcagatgccgtggccgatgtgttcagcgaactgtactgggatgcagaaaaggtcagctcgcaatcaggagagaagaaaaaacaatagaaatcaggtgattcgaatgatccgttttaccggcaaatgcctgctgatcgccattgtcatgtttttcggcgttttgttcggcatgcagcaggcaaacagcggaatgcttgatatgaaaggatacaaagatccctccttaaaaggagcattcacgctcggcggcggagaaggacaggaaaaagaagcttccattttggggcaaaccgttacggcgaaagatctggaagaaaaacaaaaacagctggaacaggcggaaaccttcaacctgttttcaaaagccggagaaaccctttcaaataccgtgacggactcggcgcaggcgatgtatgagtgggtttcgaaactgaaccgttagcattgatgaagagaaaagcggatgattccttaaaggaagcttttctctttcttgttttaattgaatgtttacaatcctattgatataatctaagctagtgtattttgcgtttaatagtaggagtgatagattgtgacagataaagaaaagcgtttagagaggcagtcaagaatccggaatttctccatcatcgcccacatagaccacggcaaatcgaccttggcggatcggattttagaaaaaacatcggcgatcacccagcgggaaatgaaagaacaattgcttgattcaatggaccttgaacgcgaacggggaattaccatcaaattaaattccgttcagctgaaatacaaagcaaaagacggagaagaatatatatttcatctcatcgacacgcccggacacgtcgactttacatatgaagtttcgcgaagcctggctgcctgtgaaggcgcgattctcgttgttgatgcggctcagggaatagaagcgcagacattggcgaacgtctatctggcgcttgataatgatcttgagattcttcctgtcattaataaaatcgatctcccgagcgcagagccagaacgtgtgcgtcaagaggttgaggacgttatcggccttgacgcttcagacgccgtcctcgcttcagcgaaagcgggcatcggcatcgaagacattttagaacagatcgtagaaaaagtgccggctcccgcgggagatccggaagctccgctgaaagcgctcatctttgactcgctttatgacgcgtaccgcggagtcgtcgcgtatatcagagtcgtagaaggaacggtcaaaccgggccagaaaattaaaatgatggcaaccggaaaagagtttgaagtcatcgaagtcggcgtcttcacgccgaaagcgcagccggctgacgaattgacagtcggtgacgtaggctatttgacagccgcaatcaaaaacgtcggcgacacccgtgtcggtgatacgatcacgagcgcggttaagcctgcggcagaagcgcttccgggctaccgcaaactcaatccgatggtatactgcggactttatccgattgacacagccaaatataatgatttgcgcgaggctctggaaaaacttgaattgaacgattcatctcttcaatacgaggcggagacgtcacaagccctcggcttcggcttccgctgcggttttttaggaatgcttcacatggaaatcattcaagagcggattgaacgggaatttaaaattgaccttatcacgaccgcaccgagcgttatttatgacgtttatatgacggacggcgaaaagatcatcgtggataacccgtcaaacatgcctgacccgcaaaaaatagagcgggtggaagaaccttatgtcaaagcgacgatgatggttccgaacgattacgtcggagcggttatggagctttgtcaggggaaacggggcaactttatcgatatgcagtacttagacgccaaccgggtcagcattgtatatgagatgcctcttgcggaaatcgtatatgaattttttgatcagctgaaatccagcacgaaaggatacgcctctttcgattacgagctgatcggctacaaaccgtctaaacttgtcaagatggacattatgctgaacggagaaaaaatcgacgccctttcatttattgtgcatcgcgattacgcgtacgaacgcggaaaagtaattgtggaaaaactgaaagagcttattccgcgtcagcactttgaagtaccgattcaagcggcgatcggacagaaaatcgtggcccgctcaaccattaaggccatgcggaaaaacgtccttgcaaaatgttacggaggagacatctcgcggaaacggaagcttcttgaaaaacaaaaagaaggaaaacgccggatgaagcaggtcggctcagtagaagtgccgcaggaagcgtttatggccgttcttaaaatggatgacagcccgaaaaaataacggaagccgccgcagtcccgcgctgcggcttctttctgtaaagaagaaggtgtttcaaaatgaaatcagcttatattcatattccgttttgtgagcatatctgccactattgcgatttcaataaatattttattcagagccagcctgtcgatgagtacttaaactcactcgaaaaggaaatgataaatacaatagaacggacgggacgccctgatctccgcacgatttttatcgggggaggcacgccgacatcgctctcacccgtccagctggaaaaattgatggattccattcaccgcgtgctgaagccttctgacggactcatagaatttgccgcggaagcgaatccggatgatttgtctccggaaaaattaaaaatcctgaaaaatgccggtgtcaaccggctgagcttcggtgttcaaacctttgaagatgagcttttacaaaaaatcggcagagtgcataaacaaaaggacgtattcacttcctttgaacgtgcgagggctctcggcttcgacaacatcagtctcgatttgatgttcggcctgccgggtcagacgctggccgatcttgacaattccgtcaaaacggctttgtctcttgatgcagagcactattccgtttactcgctgatcgtagagccgaaaacggtgttttataatttaatgcaaaaaggccgcctgcatctcccggcgcaagaacaagaggccgagatgtatgaaacggtcatgaggcagatgagtgaagcgggcatccttcaatacgagatcagtaactttgcaaagcccggatacgagtcgcggcataatctgacgtattggagcaatgaagagtatttcggttttggcgcaggcgctcacggatatatcagcggcacgcgcaccgtcaacgccgggcctgtgaaacattacatgcagctcatcgaagaaaaggggctgccttaccgtgacacgcacgaggtgacacgtgaggagcagattgaagaagaaatgttcctcggtctcagaaaaatgtccggcgtacaaaagcaagcttttctcgataaattcggacgctcggtcgacgaactgtttcccgatgttctcaaagatttaaccgaaaaaggcctgatttgtgacacgaaagaatcggttgcattaacgcatgagggcaaattattaggaaatgaggtttttggcgcttttttgggtgagttataattgacatttttcttttggtttgttacttttgatatagaattagcactcgctgaccttgagtgctaacaggggtgatgatgatgttaacaaatcgtcagctgttgatcctgcaagtgattattaatgattttatacaatcagcgcagcctgtaggatcaagaactctttcaaaaaaagacgagattacattcagctctgcaacgatcagaaacgagatggctgacttggaggaattgggctttattgaaaaaacccattcatcctcaggacggattccgtcggaaaaagggtacaggtattatgtcgatcatttgctgtcacccgtcaagctgacaaaaaccgatctggatttaattcactcgatatttaaagaaaaaatcttcgagctggaaaaaacagtccaaaaatcagcgcaaatcctgtccgacctgacaaactacacatcgattgtcctcgggccgacgctgagcgagaactatcttaaacagattcaaatcgtaccgatccagccggataaggcggtcgccattctcgtcacgaacacggggcatgtcgaaaaccgcaccatcaatttcccggctaaagtggatttggccgatattgaaaaactggtcaatatactaaacgatcgattagcgggcgtgccgatggacgaactgaatgagcgcattttcaaagaggttgtcacatatttaaggcagcatatcgccaactatgacagcatacttgaatcgctccgctccacattccatccggcggcccacgttgagaaattgtttttcggcggaaagatcaacatgctgaatcagccggagttccatgatattgaaagggtccgctcgctcttatctttaattgaaaaagagcaggatgttctgaagctgtttcagtcatcaaaagccgggatttcaatcaaaatcgggaaagaaaacgactacgaagaaatggaaaactgcagcttaatcacggccacctatacagttgatacgaaacagatcggatcaatcgccattatcgggccgacgcgcatgaattattcaagagtcgtcagcctgctgcagcacgtgacttcggacttgtcaaaagcattcacaagtttgtatgatgaataagggaattttggcaatcattttcagtcatctttttacagcatttgagggaggtgaacacaatgtcagaagaaaaacaaaccgcagaacaggttgaagcagcagaacaagaagaagtgacagaacaggcagaacaagccgcttcacaagagcagcatgaagaaacggcaggtcaggaagaagcccttcagcaccaaattgatgaattgcagggtttgcttgatgaaaaagaaaacaagcttttgcgtgttcaagcagactttgaaaactataaacgacgcagccgccttgaaatggaagctgctcagaaataccgttctcaaaacgtcgtaacggaaatccttccggcgctcgacaactttgaacgggcgttacaggtagaagctgaaagcgagcagacaaaaagcttgctgcaaggtatggaaatggtccgccgccagctgatggacgcacttgaaaaagaaggcgttcaagccatcgaagctgtcggccaggaatttgatccgaaccttcaccaagccgtcatgcaggtggaagatgaaaacttcggcagcaatattgttatcgaagaactgcaaaaaggctacaaactgaaggatcgcgtcattcgtccttcaatggtaaaagtgaatcaataactacatagcaggaggtaattcaaagtgagtaaagtaatcggaattgacttgggtacgacaaactcatgtgtggcagtgcttgaaggcggagagcctacagttatcgccaacgctgaaggaaaccgtacgactccgtcagtcgttgcatttaaaaacggcgagcgccaagtaggggaagtggcaaaacgccaatccatcacaaaccctaacacaatcatgtctgtcaaacgccatatgggtactgactataaagtggaaatcgaaggaaaagactacacgcctcaagaagtgtcagctattatccttcagcatctgaaagcatatgctgaaagctacctcggcgaaacagtttcaaaagccgttatcacggttcctgcatacttcaacgatgcagagcgccaagcgacaaaagatgccggtaaaatcgccggtcttgaagtagagcgtattatcaacgagccgactgcagcagcgcttgcatacggacttgataaaacggacgaagaccaaacaattcttgtttacgaccttggcggcggtacgtttgacgtatctgttcttgaacttggcgacggcgtgtttgaagtccgttcaactgccggtgacaaccgtcttggcggggacgactttgaccaagtcatcatcgatcatctcgtagcagaattcaaaaaagaaaacggcattgatctttcaaaagacaaaatggcgcttcagcgtttgaaagatgcggctgagaaagcgaaaaaagatctttccggcgtttcatctacacaaatttctttaccatttatcacagcgggagaagcaggtcctcttcaccttgagctgacactgacccgcgctaaattcgaagagctttccgctcaccttgttgagcgcacaatggctcctgtccgtcaggctcttcaagatgcggatctttctgcgagcgaaatcgacaaagttatccttgtcggcggttcaacacgtattcctgccgtacaggaagcaatcaaaaaagaaacgggtaaagaagcgcataaaggcgtaaaccctgatgaagttgtagcgctgggtgcagcgattcaaggcggcgtcatcacgggagacgtaaaagacgttgttcttcttgacgttacaccgctttctcttggtattgaaacaatgggcggcgtgttcacaaaactgatcgatcgcaacacgacaattccgacgagcaagtctcaagtattctcaactgcagctgacaaccaaacggctgttgacattcacgtgcttcaaggtgagcgcccgatgtctgccgacaacaaaacgctcggccgcttccagcttactgatatcccgcctgcaccgcgcggcgtaccgcaaatcgaagtttctttcgatattgacaaaaacggtatcgtaaacgtaagagcgaaagatttaggcacaggaaaagaacaaaacattactatcaaatcttcttcaggtctttctgatgatgagatcgaacgcatggtaaaagaagcggaagaaaacgctgacgctgatgcgaagagaaaagaagaaatcgaagtccgcaacgaagctgaccagcttgtgttccaaacggaaaaaacattaaaagatctggaaggcaaagtggacgaagagcaagtgaaaaaagcaaacgacgcgaaagacgcgctgaaagccgctatcgagaaaaacgaaattgaagacatcaaagcgaaaaaagatgagcttcaaacaatcgttcaagagctttctatgaagctttacgaagaagcggcgaaagcgcagcaggctgaaggcggagcaaacgctgaaggcaaaaaagcggatgacaacgttgtcgatgcggaatacgaagaagtaaaagacgacgaaacgaaaaaataagttctgtcccgcatggctataggcggaagaacacacatcatattctgattcaacagacagaaagtcaaagtcaggcatctcttggctttgactttttttcttgcccgggataaaaggaattgaaaaaacataattcaaaatgatacaatctaatttatgtgagaaattcgggagagtgaagcgagatgagtaagcgtgattactatgaagtgcttggggtaagtaagagcgcttcaaaggatgaaatcaaaaaagcctatcggaagctttcaaaaaaatatcatcctgatatcaataaagaatccggagcagatgaaaaattcaaagaggtaaaagaagcgtacgaagcgctctcagacgaccaaaaacgcgctcaatatgaccaattcggccatacagaccctaaccagggattcggcggcggtttcggaggcggcggagacttcggcggcttcggtttcgatgacatcttctcaagcatcttcggaggcggcacgagacgccgtgacccgaatgcgccgcggcaaggcgcggatctgcagtatacaatgaccctgtcatttgaagacgcggctttcgggaaagaaacgatcattgaaattccgcgcgaagagaattgcgaaacatgtaaagggtctggcgcgaagccgggaacaaagccggatacgtgctcgcactgcggaggttctggccagctgaacgtcgaacagaacacgccgtttggcaaagtggttaaccgaagagtctgccaccactgtgaaggaacaggaaaaatcatcaaaaacaagtgttctgactgcggcggcacgggcaaagtgaaaaaacggaaaaaaatcaatgtcacgattcctgccggtgtggatgacggacagcagctgcgcgttccgggccaaggtgaaccgggcgtaaacggagggccggcgggagatctgtttgtcgtattccatgtgcgcgcccacgagttctttgagcgcgacggagacgatatttattgcgaaatgccgttaacgtttgcccaagcggcactcggagacgaagtggaagtgccgacgcttcacggaaaagtgaaattgaaaatacctgccggcacacaaacaggcacgaaattcagattaagaggcaaaggcgttcagaacgtccggggctacggacaaggcgaccagcacattgtcgtccgcgtcgtcacaccgacgaatctgacagacaaacaaaaagacatcatccgcgagttcgctgaagtcagcggaaacctgccggatgaacaagaaatgagtttctttgacaaagtaaaacgcgcatttaaaggcgagtaatgattggataggagttggtagttttgaaatggtccgaaatcagcattcacacaacacatgaagcggtcgaacccatctcaaatattttgcatgaagctggtgcgagcggggttgtcatcgaagatccgcttgatttaatgaaagagcgtgagaatgtttacggggaaatctaccagctcgaccccaatgattaccccgatgagggtgtcattgtcaaagcgtatctgccgatcaacagtttcctcggcgaaacggtggacggcattaaagagacgattaataatctgcttttgtacgacattgatttgggcagaaacacaatcaccatttctgaagttaatgaagaagaatgggcgacagcttggaaaaagtattatcatcctgtgaaaatttctgaaaagttcacgatcgttcccacttgggaaacgtacacacctgttcatacagatgaactgattatcgaaatggatccgggtatggcattcggtacgggaacgcatccgacaacggttctgtgcattcaggcgcttgagcgtatcgttcaaaaaggcgaccgtataattgatgtcggcaccggttcaggaattttaagcatcgcggccgccatgcttgaggccgagtcggttcatgcgtatgaccttgatccggtcgctgttgaaagtgcgcgtctgaatgtgaaattgaacaaagtgagtgatacggccgaagtgaagcagaacaatttgttagacggcatcacgggcgaacatgatgtcattgtcgcaaatattttggcggaagtgattctccgctttacatcacaggcgtacgacctgctcaaagacggaggccattttattacttcaggcattatcggccagaaaaaacaggaagtaaaagaagcgttggaaaaagccggctttaccatcatagaaattctgtctatggaagattgggtcagcatcatcgcgaaaaaataacagttagtaggtgtcacagcgtatgcaacgatattttatcgagctcacgaagcaggagatggacgaaactcccgattttcaaatcacgggggaagacgtccaccatatagcgaacgtcatgagaatgagtgcgggcggccggattatctgctgttcgaaagacggccatgaagcgttatgcctgctaaaagaggtttctaaagatcatatatcatgcagcattgctgaatggacgggtgaaaaccgtgaactgcctttgaagatcaggatcgcaagcggcctcccgaaaggcgataagcttgaatggattatccaaaaagggaccgagctgggggcaagtatgttcatcccttttcaaggcgccagatccgtcgttaagctagacgacaaaaaggcaaagaaaaagcgggagagatgggcgaaaatcgcgaaggaagcggcggagcaatcgtaccgcaatgaaattcccgaagtgaaaaccgttcatacgttccggcagctgcttgaaatggcggagaatgtcgataaatgtgtcgttgcatacgaggagtcatcaaagcagggagaaacgggcgctttcgctgcggagctcaaaagccttccgcaaggttcgtctcttttaatcgtattcggccctgaaggcggtctgactgagtctgaagttcatcagctttcagaaaaaggcgccgtcttatgcggcctcggaccgagaattttacggactgaaactgcgcctctttacgcgttaagcgcagtttcctatcatacagagttattaagaggtgatcagtaatggcaactgttgcttttcatacccttggctgcaaggtcaaccattatgaaacagaagcaatctggcagctgtttaaagatgcgggttatgaacgaaaagaattcgaacagacagcagatgtatatgtcattaatacatgtacggtaacaaacacgggagataaaaaaagccgtcaagtcatcagacgggcgatccgccaaaatcctgacggcgtcatctgcgtaacagggtgctatgcgcaaacctctccggcagaaattatggccatcccgggtgttgacatcgtcgtcggcacgcaggatcgtgaaaaaatgctcggttacattgagcagtacagggaagagcgccagccgatcaacggcgtcggcaatattatgaaagcacgcgtgtttgaagagctggatgttcccgcttttactgaccgcacaagagcgtcgttaaaaatccaagagggctgcaacaacttctgtacgttctgcattatcccttgggcgcgcggcctgcttcgttcccgcgatccggaagaagtcattaaacaggcgcagcagctggtggatgccggctataaagaaatcgtcctgacggggattcatacgggcggctacggcgaagatatgaaagattataatttcgccaagcttctccgcgagcttgatacacgtgtagaaggattgaagcggatcagaatttcatctattgaagcaagccaaatcactgatgaagtgattgaagtgctggatgcgtctgataaaatcgtccgtcaccttcatatcccgattcagtcaggatcaaacaccgttctgaaacggatgagacgcaaatatacgatggaatttttcgcggaccgtttaaataagctgaaagaagcgctgccgggtctggccgtcacatctgatgtcatcgtcggtttcccgggagaaacggaagaagaatttatggaaacataccggttcattaaagaacataagttttcagagcttcacgtattcccttacagcaaacgcaccggaacacctgcagccagaatggaagaccaggttgacgagaacgtgaaaaacgaacgggtgcataagctgatcgcgctgtctgaccagcttgcaaaagaatacgcctccgattatgaaggagaggttctggaaatcattccggaagaggcgtttaaagagtctgatgaggagggcatgttcgtcggctatacggacaattacatgaaagtcgtcttcaaaggcacggaagatgtaatcggcaaacttgtcaaagtcaaaattcaaaaagcgggctatccgtataacgaaggacaattcgtccgcgtcgttgaggatgaaatgacccgaaacatgcgcatgtcttcataactgataaaaaaaccggtgccttcccgcatcggtttttttacggtttcggaggaatcagcctgtcaatcagccggtaaaacaaatgtgtgaacggcagaaacaataaggcggtgactacgttaaataacaggctgaaatgcgcaatcatctgcgcgggatcatcagacaggcgctccgtaaaacctgctgatgcggacaggaagggaaatacgagcagcacgccgagaatattaaacacaacgtgagcaccggcggtctgtctggcggcataaccgcctgaaacagcagccatgacggccgtgacgcatgtcccgatattagatcccagaacgacgctgaccgcttgttcaatgccgatcaccccttcgttcataaaactcatcaaaatgccgatgcagacggagcttgaatgaatgattgccgtcaatatcataccgataaaaagagcggaccagctcgaatcattcacatgtcgcaatacctccgcccccgccttcatttctgtcagcggaacggcgagccggctgaagcatgtgatgcaaaaaaagatgatgccgagaccgaggaagcttatgccgatctgcctgaacggatatttacggaggaggataaacacaaggcctccgataaaaagcacccaaatgagcacatccatctttatggctaaaaactccgtcgtaaacgtggagccgacattcgtgccgagaatcatcggaatggtccgtttaaaagataaagcgcctgcgctgacaaagccgatgacaatgaccatgaaggctgagctgctctgaagaaaaccggtgaatacgatgcttatgagaaaagctttcaaagggtggtcggtaaataagagcaggctcttctcaatttttgaatacgttaaggcgatcaggccctgcctgagcaggctcattccgagtaaaaaaaccaggataagtgcggtaaagagaatcagtatcatcaaacgaaacacccctttccatcattatatagacaagcagccttattcatgacggaaaagtgagctcgcttagttgacctgactgatggcttatattataatgtcaaagtacatgtttatatatgtatctttttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgcgaattttatgaaaaacctagcgtaaagcgcaagaaaaagtcagaagctgctagaaaacgcaaattctaaaagagggtggatttatgagtcttcttgagcgacttaaccaagatatgaagctgtatatgaaaagccgtgagaaagacaaactgactgtcgttcgaatggtgaaagcttcacttcaaaacgaagcaattaagcttaagaaagacagtttgaccgaggatgaggaacttactgtcctatctcgtgaacttaagcaacgtaaagactccctccatgaattttcaaacgctaatcgtttagatttagtagataaagttcaaaaagagctggacattttagaagtttatttaccgaagcagctttctgaagaagagctgcagacaatcgtaaatgaaaccatcgctgaagtcggtgcgagctccaaagcggacatgggcaaagtgatgagtgctattatgcctaaagtaaaaggtaaagctgacggcagcgtaattaacagacttgtcagcagtcaattatcttaattgacaaaaaagacatctttccttgagagatgtctttttttatacataaaaaaatgaaactaaagtacatttgttacgtatataaagaagaacgaaatgggaaggagggtatatttgccttgttccgaaaaaaaaacggaattgctgttgctctattgggcttatttgtattatctttattaggggttcaattgaacgcgaaagctgatcacccatcggtttatgtcatcccggttgagaaaaatgtcgaacaggggctcgcctcgtttttatcgcgttctttcaaagaagcgaaggagtccggcgcgtcacacattattcttgacatcaatacaccgggaggcgccgttcaatcagccttggatattgcggatatcatcggccgcgcggatgtgcctgttaccgcttacgttaataaacgggcgctttctgccggagcgtatatagcgcttcaggcagatgaaatctatatggcgccgggcggaaaaatgggtgccgcagccatcatcgacggaaagggaaacgcggcagacaaaaaggcccaatcactgtggcatgcagaaatggaggacgcagcggttaaaaacaaccgaaatccgaaatacgccctagccatggcagatcccgccattaatgcaaaggaagcgggcgccccaaagggaaaactgctgacactgacagctgaaaaagccaaggaagtcggatattcggagggcacggtttcagaccttgatgctttatatacaaagctcggttttgacaaagcggatgttcaccatgcaaaagaaggtttcatcggcaaactgggcagatggctgacaaatccgtttgttgtccccgtcttattaacgcttgctttgcttggtttgaccattgaattgttctcgccgggcctcgggataccgggtgccgtcggactgacggccatgctgctgtttttcacggggcatatcgctgccggattcgccggctatgacagcgtattcttattttgcgcgggcttggtttttatccttttagagatatttctgcccggaggcataatcggtcttatcggtattgcaggcgtcatcgcgagcctctttctcgctgcgggcagctttaccgtcatggcggtttctctcttgatcgccattgctgtgtctattacagcctttatcatattaacaagggtgttggggaaacgaatgaaattctttaaaaaattaatattaactgattcaacaagcacggagagcggttatgtttcaaatcagaaccggacggagctgttgggaaaagtcggcgttaccgctacagccctcagaccgtcaggcaccgtcattattgatgatgaacgtctggatgtcgtctcggaaggatcattcactgaaaaagacagacaggtgaaagtagtgaaagcggaaggctcacgcattgtcgtgagagaaatatagatgataaccttgaggaggaattagatggaactgtcaagtttggcgattttagcattagttgctgctgccattattgtgttagccatattcttcacctttgtaccggtgatgctatggatttcggcgcttgcggcaggagtcagaatcagcattttcactttggtcgggatgaggctgcggcgcgtcataccaagccgcgttgtcaatccgttaattaaagcgcacaaagccggcctatccgcaacaacaaatcagctcgaaagccattatctggccggaggtaatgtcgacagggtggtcaatgccctgattgcggcacagcgcgccaatattgagctgtcatttgaacgctgcgcagccattgacctggccgggcgtgacgtattggaagccgtacagatgagcgttaatccgaaggtcattgaaacaccgtttatcgcgggtgtcgccatggacggaattgaagtaaaagcaaaagccagaatcacggttagagccaatattgagcgccttgtcggaggagcgggagaagagacggttgtcgcccgtgtcggagaagggattgtctcgacaatcggttcttcacacaatcataaaaaagtgcttgaaaaccctgatatgatttcgcagaccgtacttggcaaagggctggattcaggcaccgcatttgaaattctttcgattgacatcgccgacgtggatatcggcaaaaacatcggagcgattcttcagacggatcaggcagaagcagacaaaaacattgcgcaggccaaagccgaagagcgccgcgccatggcggtcgcccaagagcaggaaatgcgcgctcgcgtagaagaaatgcgtgcaaaagtcgtggaagcagaagccgaagtgccgcttgcgatggcagaagcgttgcgtgaaggaaacatcggcgtcatggactatatgaacataaaaaatatcgacgcggatacggacatgagggattctatcggcaagctgacgaatgaccagcaagatgaagaccaacaataacctctctattaaggagggagccgctatatgcacgagattctgacaaatccgctcgtcattgccgccgtcatcggcattatatcggcaatattcggcaagaaaaacaaagatgaaaaacgtccgccgggtacacgtcccggaaatcaggcaaaaaagcaggatcaaaaacagccgcagaaagagcataagccggaagcggaagaattgcctgccgtttcagaagagaacccttttgagcaaaaaagaagggaagctgaaaagcgcctagcggagacggagcagatgtttaacgggctcgaacataagctgacatccgcacgcgcacgaaacgcgtctctgaagaaatcagccctcaaaataaataaagaaactgcggtccaaggcattatattcagtgaggttttgggtccgccccgtgcaaaaaaaccgcaccggaccatgcggaacatcggtaaaaaataaagtgttagaaccccttttcaaatcatacatatgagatgaaagggggttctttttttatggggcaaagaaagaatcgtgtaaaggcatggctgacaagagcattggaaattcccccggacgttatgatggatctgcctcgtattacgatggtcggcagacttcatatctacatagagaatcacagaggcctcctgctgttcagtgaagaagaagtcaggctgatgctcaagcaggggcagtgtatcatatcaggaaaaaacttggtcattaaggcaatccttcctgaggaaatccttttggaaggcacgatagatcacgtacgatatgtcgattcataaagccgggggggaataatgtgaaaaacaaatggctgtcatttttttcgggtaaagtccaaatggaagtcaaaggaaaagggattgaacggctgctgaatgaatgcacgagaaacggaatcgccatctttgcggtgaaaaaaaagcaagactgtgttctgctgatgattcagcttcaagatgtacatgctttcagaagagtcatcagaaaacatgaatgcaaagcaagctttacaaaaagaaagggtcttccctttctgcttctcaaatcaaaattaaatctgggcttcactgcgggatttgtgatattttttgttatattgtttcttttgtccaacatgatttgggaaattgatattaaaggggccaagccagaaaccgagcatcagatggtaaagcaccttgaagaaatcggtgtgaaaaaaggccgtttgcaatttttaatgatgacgccggaaaaaattcaaaaatcattaacaaacggcatcgataatattacgtgggtcggtgtggaattgaacgggacagcccttcatatgaaagtggtcgaaaagaacgaaccgacaaaagaaaagtacgtgagcccccgccatatcgttgccaaaaagaaggcggtcatcaaaaggatgttcgtgcaaaaggggcagccgatggcttttgtgaacgatcatgttgacaaaggacagctcctcgtctcaggactgatcggaaatgaagaccggaaagtcgcctcaaaagcggaaatttacggagaaacatggtacaagtcagaagtaaccgtgccccttgaaacatcatttacgctatatacgggtaaagtaaggacgaagcacaagctgtctttcggatcatggggcgtgcctttttggggcttcgggtttaatgaggagccgctgaaacatccgaaaacagaggaagaaaagcatccgtttcaatttctggggatgaagcttccggtttcttacgtttcagaacagacaagagaaagtgaaacatccgtgcggacttatacgaaaggcgaagcggttcaggccggtatcaaaatgggaagacaagatgtagaaaagcgattaaacggcagcggagaggtggaaagtgaaaaagttttgcaccaatccgttgagaatggtaaagtaaagttgattattctctaccaagttatagaagatatcgttcaaaccacacctattgttcagggagactaaagaatggcagaacatttacttgcgattaatcacaaactgaaaagcccggacgaagcactttctttgttcggcagccaagatgcttttttacatttaatggagagggatctgggcattagcctcatcacacgcggtgaaaccatttacgtttccgggaatgatgaaacatttgagatcgctgacagattattgggctcgctccttactttaattcgcaaggggatcgagatttcggaacgtgatgtgctgtatgccgtgaaaatggcaaaaaaagatgaactggactattttgaaagcatgtatgaagaggaaataacgaaaacggcaaaaggcaaaccgatccgtgtcaaaaccatcggccaaagagaatatgtggcggcgatgaagaaaaacgacatggtgttcggcatcgggccggcgggaaccggcaaaacttatttggcggtcgtaaaagcggtgcatgctttaaaaaacggccacattaaaaaaatcattttaacaagacccgctgtggaagccggcgagagcctcggttttctgcccggagatttaaaggaaaaagtagatccttatctgcgcccgctgtatgatgcgctccatgatgtgctcggaagcgaccatacggagcgtcttatggaaagaggggttatcgaaatcgccccgcttgcctatatgagagggcggacgcttgacgacgcgtatgtgattcttgatgaagcccagaataccactcccgctcaaatgaaaatgtttttgacgagattgggttttggctctaaaatgatcattacgggcgacgtaagccaaattgacctgccgaaaggcgtcacatcgggacttgcagtagcgaaggacatgctgaaggacgtaaacggcatctccgtgattgaacttgaccagacagatgtggtcaggcatccgcttgttgcaaaaattattgaagcttatgataagcaaaagtaatgcaaaaatgacccgatctcccgttatcgggtcatttttatatgatgtgttcctgatgtttcagggaggaggttcttgttttgaaaaagaagggaaagggcaaaagcgcccgggaacggttccgcagtttcagacatgcccgctcagcccatgtgctgctgtacctgctgctttcagcgatcatgtttggtttgctctttattcatgtaaaacctgaatcacttaatttggatttgtttgcagtcagtgataagacgatttacgcgcccgccacagtggaagatcagcaggcgacggaatcgaaaaaacaggcggccgaagatgcggtggaagatcaatacactctgaaaaaaggctataccgacaatcggcttgacctgattacttccatttttgacagcatcggcgaagtgaaaaaagatgcggaaaaagacaaaaagtcaccttcggaaaaatcactggtaaaatcggtgaaaaacaagctgacacaggatgtcaatgaatctgtctcggaagatgccattaaatcgcttctccatgcaaacaatgaagatttctcatttgtgagggattccgtcattaccgcggtgaatacggtgatgagcagtgaaattccttctgaaaagcttgctgaagcgaaggataaggtcgcaaaagagctgaaaagcgcttctgtgccgtcaaaatatttagcggctgcgactgaaatcggaaaatacgcggtcatcccgaattacgtttttgatccgaaagcgaccgatgaaaaacgccaggaagcgtcagacagcgtccagccggtacagatcaaacagggacaggttctcgtggaagagaatgacctgattgaccgggaagtatacaggaagcttgaactgacgggtcttttgaataattccaacctgttaaaaccgatcagcggtctccttctgatgatcggcctgtttattgccacgcttgtctactattttgagaaacagcagcaggagcttaagctgaaaaataaatctcttttgctgttttctatcattacaacgcttattctcgtcattatggaagtcgtcagtctctttcagaagattgaatacaccaatatcggctatcttgtgccgatcgccgccggcgcgattttaatcaggctgctgctcaatgaaaggctcgccattttaggaagcatcattctggcgatctgcggcagtatgatgtttaatcagggtgtgacgggaacatttaattacgtcatcggcatttactatttaatcagcagcatttcaggcattctgtttttgggaaaacataatgcgagatcaaaaatattgcagacgggactgttcgtctcatttattaatatgattatcgtgctgtcgcttttattaatacaaaatacggcgctgtcaccggttgaaatcggaacgctgatgctgatgggggtcgtctcgggacttgcttcatccgttttgattatcggtctgatgccgttttttgagacgggattcggcattctttcaacaatgaggctgattgaactgtctaatccgaatcatcccctgcttcgaaagattttaacggaaacacccggtacatatcatcacagcgtcatggtggcaaatctgtcggaagcggcttgtgaagccgtaggggcaaacggtcttttagcacgggtcggagcgtattatcacgatctcggcaaaacgaaacgtccgcaatattttattgaaaatcagatgaatatggataatccgcatgacaagctgtctcctcagctcagcaaaaatatcattattgcacatacgacagacggtgcgaatatgctcagaagctataagtttccgaaagagcttgtggatatcgcggagcagcatcacggaacgtcccttttaaaattcttttattataaagcgaaagaaaagggcgaccagattacagagaaagagttccgctacccggggccgaagccgcaatcgaaagaagcggctattatctcagtggccgacagcgttgaagccgccgtccgttccatgcataatcccaatcccgagcggatcgaaaaactggtgcggggaattatatccgataagcttcaggacggacaattctcagaatgtgatctcacgttccgagaactggatacgatcgcaaaaacactatgtgcgactttaaaaggaattttccactcccggattgaatatccggaggctacgaagaaggtgaaataaatgagtttactcatagatattgttgatgaaacgaacagcgtctcagctgatgcgctccaagaagtggagaagctgctccaattcgcggcggaaaaagaaggcattcaggaccaggctgaagtatcggtcacgattgtgacaaatgaggaaatcagagaaatcaacagagactaccggggaaaagacactccgactgacgtcatttcgtttgcgcttgaagaagaaggcgaagacgaggttgaaatcataggcgccgacatgccgcctgttttaggagatattatcatcagcgcagacagaacgaaagagcaggcggaagagtacggccattcgtttatgagagagctcggttttctggccgtgcacggctttttgcatttgcttggctatgatcacatgacaaaagaagaagaggaagaaatgttttcaaagcaaaaggatttgctggatgagtatggactcacgagatcataaaaacgagtggagcaggttcctgaagagctttgtccatgcatggaggggaatctggaaaacggcgcggtcagagcggaattttcaatttcatattaccgcggcctgcgccgttatcgtttgcggttttctcaccgggctgagcacagccgaatgggccgttgttttggtgctgatcggagggatgcttgctttggagcttttaaatacggcgatagagcatgttgtggatttagttaccgatcagtatcacccgctcgcaaaagcggcaaaggacgcggccgccggagccgtttgcgtctttgccgtgatatcgtgtatcattggtttactcatcttcttgccgaagatatgttagcagaagattcttacaattattttacattgccaaaaatgggcgtgaaaaaccaatcataattatgtaaaataaaagtgacagcggtatcatacaggataaaggtaagagaggaattaagtacacatgaacagacaagaattgattgcagaagcattaaaagcgcgggacacagcgtatgtgccgtattcaaatttcagagtgggagccgctcttcttaccaaagacggaaaagtgtacagaggctgcaacatcgaaaatgcggcatacagcatgtgcaactgtgctgaacgcacggcgatattcaaagctgtttccgagggggatacggaatttgcgatgctcgccgtggctgcggatactccgggaccggtttcgccgtgcggagcctgcagacaagtaatttccgagctgtgctcaaaggatatgcttgttattctgaccaacttacaaggacaaataaaagaaatgactgcggaagaattattaccgggcgcattttcatcggaggatttacatgacgaacgaaagctttaaatcaggatttgtatctatcatcggaaggccgaatgtaggaaagtctacctttttaaacagggtcatcggtcaaaagatcgccatcatgagcgacaaaccccagacgacaagaaataaagtccaaggggtgctgacaaccggcacgtcgcagaccatttttattgatacaccgggcattcacaaaccaaagcacaagcttggcgactttatgatgaaagtggcgcagaatacgctgaaagaagttgacttggtgttatttatgattaacgccgaagaagggtacggaaaaggagacgagtttatcattgaaaagctcggacagacgtctacaccggtctttctgatcgtaaacaaaattgataagatccaccctgaccagctgcttcttttaattgatgagtaccgtacgcgctatccgtttaaagaaatcgtgccgatctcagctttggaagggaacaacgtcgaaacccttctcgcgcagattgaagcgtatttaccggaagggcctcagttctatccgagcgatcaggtgactgaccaccccgagcggttcattatttctgaactgatcagagaaaaggtgctccatctgacaagggaagaagtgccgcacagcatcgctgtcgctatcgagtccattaaagggcaggaaaacggctccgtccatgtcgctgccaccattgtggtcgagcgggattctcaaaaaggcatcgtcatcggcaaaaaaggagcgcttctgaaagaagtcggcaaaagagcgcgggctgatattgaagctcttttgggctcacgcgtttacctggaattatgggtgaaggtgcagaaggactggcggaataaaatgtctcagctgcgtgatttcggcttcaaagaggatgaatattaattcatctaaggcgcatgcctgaggtgtgagattacctcacagaagcagggattcgttagcaaaatttgtttaacatgaaaaggaggacatcaggtcaagataagggtaagaatttggatttgcaagctagtttaatgatgaaaggtgggttttttgtgttgaattttacctggaacgtattttctcaaacaggaagtgttgatacgtaccttctttttaaagaactggaaaaagagaacctggaaagacccgaagaaccggaagatgagctagcccgaattgattttccaattttgtaaacctcttggcccctcccattgttggaaggtgcggaaatgctgactaaatgtgaaggaatcgtgctccgtacgaatgactacggggagacgaataaaatcgtgacattgctgacgagggaacacggcaaaatcggcgtcatggcaaggggcgccaggaagtcagccagccggctgtcagcagtcagccagccgtttttgtacgggtcatttttaatgcaaagaacatccggactcggcacgctccagcagggtgaaatgattctcagcatgagaacgatcagagaagatttatttttgacggcgtatgccgcttttatcgctgaactcactgacaaaggaacggaagagaagaaaccgaacccctatttattcgaattgattctcgaatcctttaagaggctgaatgacgggactgacccggacgtgatcaccttcatcgtgcagatgaaaatgctcggcgtcatggggctgtatccggagctgaatcattgtgtccactgcaaaagcggggaaggaacgtttcatttttcgataagagataacgggtttatctgccaccgctgctttgaaaaggatccgtacagagttccgatttcgccgcaaacggcaaggctgctaaggcttttttattactttgatatcggaaggctcggcagcgtctcgttaaaacaggaaaccaaaaacgaaattaaacgggtcattgatctgtattacgaggaatattcaggactttatttaaagtcaaaacggtttttagatcagatggaaagcatgaagaaccttttggatgaaaacaaaagttgacattctgcccatctttttatatgatcatttattataaaatatgttgcagtgacagaaagaagtacttgcgtccaactcatacaagcgaccttagggcagtgtaagctaaggatgagcgcgcaacgaaaggcattctcgagcaaccctttaaaaagaggctgagtgattcacatcctcagcaactagggtggaaccgcgggagaactctcgtccctatgtttgcggccggcaagcatagagacgggagttttttggttgccgccgcacttgtaaaagaatggagaaagtggaggtgcttgaaatgaacattcaagatatgattttaaccttgcagaagcactggtcgaatgaaggctgtgtgctcatgcagtcgtatgatgtggagaaaggcgcaggcacaatgagcccgtatacatttttacgaagcatcgggccggaaccgtggagagtggcttacgttgagccgtccagacggcctgcggacggacggtacggtgaaaacccgaacaggctctatcagcatcatcaattccaagtcattatcaagccgtcgcctgataacattcaagagctttaccttgattcattgcgtgcgctcggcattgacccgcttgaacatgatatccgtttcgtagaagacaactgggaaaacccgtctttaggctgtgcaggtctcggctgggaagtatggcttgacgggatggaaattactcagtttacatacttccagcaggtgggcggaattgaatgtaaaccggtatccgttgagatcacgtatggtattgaacgtctcgcgtcatatattcaggataaagaaaacgtctttgatcttgaatggacgtcaggatttactgtgaaagatttatttatgatggctgaatatgagcattccgtttatacttttgaaacatctgacgtggatatgcttttccatttgttcagcacctatgaaaaagaagcgatcagacaaatggataacgggctcgtgcatccggcctatgattatgtgctgaaatgctctcacacatttaatctgctcgatgcaaaaggcgcgatctcggtgacggagcggacgggttatatcggccgtgtccgcaacttagcgagaaaagtggcaaaaacgtattatgaagaacgggaaaaattagggttcccaatgcttaaagaggagggctcttcccatgagtaaacaagacttgcttttagagatcggactcgaggaaatgccggcgcggtttttacatgacagcatggtgcagctcggtgaaaagctgaccgactggctggctgaaaaaaatatcgcccatggcgaagtgaaactttttaatacgccgagacgtctggcagtatatataaaagacgtagcagaaaaacaggctgatattcaggaagaagcaaaaggccctgcgaaaaaaatcgctctggatgctgacggaaactggacaaaagccgctatcggattttcaaaaggccaaggcgccggagtggatgatctgtatataaaagatgtaaacggcacggaatatgtcttcgttcaaaaattccaggcgggacaagagacgaagacacttttaccgcagctggaaaatttgattgccggaatgcattttccgaaaaacatgcgctggggcacgcaggatctgcgctatatccgtccgatcaaatggattatcgctctctttgggaaagacgtcattccgtttgaaatcacaaatgtcgagacgggccggaacacgcagggacaccgctttctcggccaagaagtatctgttgatgcaccgtcatcatacgaaaagctgctgaaagaacaaagcgtcattgctgacccgaaagaacgcaaacaaatgatccaaagccagctggacgcgcttgcggccgagaagaaatggaacattccgatcgatgaggacctgctgaacgaagtcaaccatctggtggaatacccgacggcgctttacggatcttttgaatccgagtttctttctatccctgaagaagtacttgtaacaacaatgaaagagcatcagcgctacttcccggtaaaagatgaaaacgggaatctgctgcctcattttattacggtaagaaacgggaacagccatgcaattgaaaatgttgcccgcggaaacgagaaagtgctgagagcaaggctttcagatgctgcgttcttctacaaagaagaccaaaagctgaacattgatgaaaacgtgaagaaactggaaaatatcgttttccatgaagagctcggctcccttgaagataaagtaagaagagcggccgccattgcgggcaaacttgccgtccgcctgaaagcggatgaacagacgcaaaaccttgtgaagcgcgccgcagagatttctaaatttgacctggttacacatatgatctatgagttccctgagcttcagggcgtaatgggagaaaaatatgcgcgcatgctcggtgaagatgatgccgtcgctgccgctgtcaatgagcactatatgccgagagcggccgggggagaagtgccttcaacctttaccggcgcggtcgtggcgttagctgataaactggacacgattgcttccttcttcagcattgacgtaattccgacaggttctcaggatccgtacggattgcgccgtcaggcaagcggcatcgtttccattctgatcgaccgcaattggggcatttcgtttaaagagctgctgtcattgacagaaacggaaaaagaaaatgagctcctcgatttctttacacagcgtctgaaatacgtcttaaacgctgaagacatccgtcatgacgttattgaagccgttctggacagcacagagcttgagccgtatgcagccgttcataaggcaagagtgcttgagaagcacctcggcacacccggctttaaagaaacggctgaatcactcggccgggtcatctccatcagcaaaaaaggcgagagccgcgatgtcaagccggatctgtttgaaaatgaacaggagaaaaagctgtatgacgcttatcaaaaaacaaaagacagtgtcgcggaaagctttgcctccaaaaactatgaacaggcgcttgccgtgctcagcggattaaaggagccgattgaagactactttaatcacacgatggtaaatgcggacgatgaagcattaaaaaccaaccgtttagcgcaaatgaccgctcttgcagatgtgatcaagtcttttgctaatatgaatcatcttattgtaaaataaagaaaaagacggttgctgtgtgatcggcaatcgtcttttccccttttacataaacatcacagaatgaaaacatagataaagaaacccttccataaaggtggtgagtacgatcgaattaaataaacggcaagaacaaattttacagattgtaaaggaaaacggcccgattaccggagagcatatcgcagaacagctcaatttaacgagggccacgctgcggccggacttggccatactcaccatgtcaggcttcttagaggcccgtccgcgggtcggttatttttatacggggaaaacgggaaatcagctgcttgcggataaattgaaaaagctgcaagtgaaagattttcaatcgatccctgttgtcatcaatgagaatgtctcggtatacgatgccatctgcaccatgtttttagaagatgtcggcacgttatttgtcgtagatcgtgatgctgtcttagtcggtgtgctgtcacgcaaagatttgctgcgggcgagcatcggccagcaggaacttgcctcaataccggttcatattatcatgacaagaatgccgaatatcgccgtctgccggcgtgacgattatgtgatggacatcgccaagtatttaattgaaaaacagatcgatgccctgcccgttattaaagatacggataaaggctttgaggtcatcggccggtttaccaaaacgaatatgactaagatacttgtcagtttatcagaaaatgaaatcatataagcttgaaaactaacggggggataacatggacaatcgcatcatttatgtagtatcagactcagtcggagaaaccgccgaactcgttgtaaaagcctcgctcagccagtttaacggctcagccgatgatacgcatatcagaagaataccttatgtggaagatatcggcaccattaatgaagtcgtgtctctcgccaaagcggacggcggcattatttgttttacgctcgttgttcctgaaatgcgcaaatacctggttgaacaagcggaaaaagcgaatgtgctgtattacgatattatcggtccgctcatcgataaaatggaatcggcttacggtctgaccgctaaatatgaaccgggccgcgtccgccagcttgatgaagattatttcaaaaaggtcgaggcgatcgagtttgccgtcaaatatgacgatggcagagatccaagaggcattttaaaagccgatatcatcctgctcggagtatccagaacgtctaaaaccccattatcacaatatcttgcccataagcgtctgaaagtggccaatgtgccgatcgttcctgaggtcgatccgccggaagaactgttcagcgttgatccgaaaaaatgcatcggcttaaaaatcagccctgataaactgaaccatatacgaaaagaacggttaaaatctctcggcttaaatgacaaagccatttacgccaatatcaacagaattaaagaagagctggagtattttgagaaaatcgtggaccggatcggctgccaagtcgttgacgtttcgaataaagcggtcgaggaaacagcgaacatcattcatcatctcaaaacaaagggccgataactcaggacgctttatcctgggtttttgggtatgcaaatagggaataaacaaaaaggatggcatctttgcgaagtttgtattataataaaaaattgtgataaaatgtttatttttaggtttaagcttcgtgtgatacgaataaactattatgggtaagatgtcaagaataactcccggaaatttttcgacaaagctcaaaatagatccgcagtcatggagcatatgcgatttcgcttgtttttatgcaggagattgatggagggatggagaattagtcttctaaatgaaaaagaaaagacgatttttgtcgatgcagacgcatgccccgtaaaagaggaaataatgctcattgcatcgcaatacagcgttcgggttattttcgtcgcatcatttgaacactaccagctttccagaagcaaagacgagaactgggtatacgttgatcctcataaagaagcggcagacttatatatcgcaaactatgtgagatcgggagacgtcgtagtcacgcaggatatcggtttagcctctcttttgctgaacagaaatattgccgtcttatcggaaaggggccgttcttatactgaagacacgattgacttcgctctgatgagccgtcatatgtcaggcaaaatgagaagaagcggcattcattccaaaggacctaaaaaattaaataaagaagatcggaatcgatttgttaccctgcttaaaaaaatcctgtcgaatgatgaagggatttcaaatcaaaacatcgaataatgtacgacggagtgttataagatgggaaaccgcataccagatgaagtagttaatcaggtgcagcagtcagcagacattgttgaagtcataggtgattatgtccaattgaaaaagcaaggccgcaactactttgggctctgtccgtttcacggggaaaacacgccctcgttttccgtctccagcgataagcagatctttcattgcttcggatgcggtgcgggcgggaacgttttctctttcttacggcagatggaaggttattcatttacggaagctgtttctcaccttgcggataaatatcagattgatttccctgatgatataacgattcactctgcatccaggccggaatcttccggagagcagaagatggcggaagcccacgagcttctgaagaaattttaccatcatttgctaataaatacaaaggaaggccaggaagcgttagattaccttttatcaaggggttttacgaaagagctcatagatgagtttgaaatcggctacgcgctggattcctgggatttcatgacgaaattcttgaaaaagcgcggttttgaggaagaactgatggaaaaagcgggtctgctgatcagaagggaagacggcagcgggtattttgaccgtttcagaaacagaattatgtttcccattcatgatcaccacggagccgtggcggctttttcaggaagggcgctcggaagccagcagccgaaatatatgaacagcccggaaacgccgctgtttcataaatctaagctgctgtataactttcataaggcgcgcctgccgatcaggaaagaggagagagccgttctgtttgaaggcttcgctgacgtcatatccgccgtcagctcaggcgtaaaagaaagtatcgccacaatggggacgtcgctcaccgaagaacatgtgaaaatcctcaggagaaatgttcaggaggtcattctctgctacgattcggataaagccgggtacgaagctacgctgaaagcggccggcctgctccagaaagccgattgtaaggtaagagtaagcatgctgcctgacgggcttgatcctgatgattatatcagaacccggggcggagaaaaattccggaccgatatcattgatgcaagcgttacggtcatggcttttaaaatgcagtatttccgcaaagggaaaaacttatctgacgaaggagaccggctcgcttacatgaaagaagtgctgaaagaaatcagcgctctttccgggtcgcttgagcaggaaatgtatgtgaagcagctcgcctcagaattttctctttcggtagaatctttgactgaacagctttccatctacgccagacaaaacgcccccggcgacaaaaacgccgaaccgcagacaagacgggcccgggtgacgacaaaagcgaaacggcgccgtctccgtcccgcctatgagaacgcggaaagacttctgctcgctcatatgctgagagaccgaaacgtcataaagaaagtgattgagcgtgtcggctttgaatttaacattgacggacatcgtgcgctggcagcatacctgtacgctgtttatgaagagggcgctgacatgacgccgcagcatcttatggcgagaatgcaggatgaggaaatcagccagctgctttcagatatagggatgctccaagtaaacgaggagctctcagaggccgagttatccgattacgtaaaaaaagtgttggatcaccgaaaatggtcaatgataaaggaaaaagaagcagaaagagcggatgcggagaggcagaaagacttcgtgaaagctgcgtctctggctcaagaaattgttgcattgaaccgatcattaaagtaacaccacaaagaggcttgcgttctgattggcaatgattccttgcggaggagcaaatagatcgcttaacctcatcatgaattgtcatttattatccgcagccctgcatgctgaaaaagagagaaggcttccgggtcggataagaaacataccgcttttagaattcgttgcaagctttggaaggagggatccataatggctgataaacaaacccacgaaacagaaacagaacttacattagaccaggtaaaagagcagcttactgaaactggaaaaaaacgtggcgttttaacatatgaagaaattgctgaacgcatgtccagctttgaaattgaatcagaccaaatggatgagtattatgaatttttaggagaacaaggtgttgaattaattagtgaaaatgaagaaacggaagatcctaatattcaacagcttgccaaagccgaagaagaatttgaccttaatgacctcagcgtaccgcctggcgtaaagatcaatgatccagtccgcatgtaccttaaggaaatcggacgggtaaatcttctttctgctaaagaagaaatcacctacgctcaaaaaattgaagagggtgacgaggaatctaaacgcagactggctgaagcaaaccttcgtttagttgtcagcattgctaaacggtatgtcggccgcggcatgcttttcttagacttgatccaagaaggaaacatgggtctcatgaaagccgtcgagaagtttgactaccgtaaaggatataaattcagtacgtatgcgacttggtggatcagacaggcgattacacgcgccatcgctgaccaggcgagaacaatccgtatcccggttcacatggtggaaaccatcaacaaattaatccgggtgcagcgtcagcttcttcaggatcttggcagagagccgacaccggaagagattgctgaagacatggatcttacgcctgaaaaagtccgtgaaatattaaaaattgctcaagagcctgtttctttagaaacgccgatcggtgaagaggacgactcacatctcggtgatttcatcgaagaccaggaagcgacatctccgtcggatcatgcggcatatgagcttttaaaagaacagctggaagatgtgctggatacgttgacagatcgtgaagaaaacgtgctgcgtctccgtttcggtctggatgacggacgcacaagaactttggaagaagtaggcaaagtgtttggagtaacgagagagcgtattcgccaaattgaagcaaaagcgcttcgcaaattgagacatccgagcagaagcaaacgtctgaaggattttctcgaatagaatggaacgggtctttttgatccgttcttttttatgtataagatatatggataatatacctttattttactggataagcatatgttttgcaaatgagtttggaaaaaatgcggcatgtcctgaaagggggaaaatgagataagtttatttatattctttattgtaagcgtatacaattcattatacaatagaataaagataattttgtgataaacaaaacagttatttttgctttttgtataaattgtgaaatcaatgaaattgctgagcaagaccatttactttttgtaaaaataagttagaattagaagtgtttacatagggggagaatgaaaaagggggatggagatatgaagtggaatccgctgattccttttttgctcattgcagtgctgggaatagggctgactttctttttagctgtaaaaggcaatggagatgcgcatcagatcgcaagcggcggtgaaagcaaaaatgccgagaaggaaactgcaaacgcttcacctgaagagatttataaagcgaactgcatcacctgtcacggggaaaactatgaaggtgtatcagggccgaacttaaaaggcgtcggcaaaagaaaagatgtcgctgagattaaaacaaaaattgaaaaaggcggcaacgggatgcccgcgggccttgtgccggccgaaaagctggatgacatggcaaaatgggtttctgacattaaataaagctttaccggtccctatataaaagacatatgaaaaactctatccgccgcttggattccgggcggtttttttatatgatagtaaaggaaaaagaacctgagaaaagttgtgatattgtgaatgaaatgaagttatctaaaagattgcagtctgtggcggaatatatccctccgggtgccctggttgctgatatcgggtcggaccacgcgtatcttccttgctatgccgttttgaatcatttggcaagccgggcaatcgccggtgaaattacagacggaccgtttctatccgccaaacagcaggtggaaaaactggacttaagcactcttatctccgtaaggaaaggtgacgggctgagcgtccttgaaaaaggagaagccggcgccattacaatcgctggcatgggcggagcgctgatcgctcatattttggagtccggaaaaacgaaattgacggggcgtgaacggctgattctgcagccgaatattcatgccgttcatataagagagtggctgtatcaggaaggctatgaactgattgatgaagtgattctcgaagaagacggaaagtgttatgaaatcctcgttgcggaaactggcgaccgtgatgcgccgtatcgggacgtgccgatggctgccggaatgcttgcgggtccgtttttattaaaagagaggaatgaagtgtttcttcggaaatggagccaggaacttaagcatactgaacaaatttatgaacagatcagccgcagcgcaaagcatgaaagtcatgaaaaattagctgaattgaaagagcggatttctctgctgaaggaggtaatcggacatgcctaaacatgtaaacggacaggaaatcatccagctgtttgaacaattttcaccgaaggcttttgcggtggaaggagataaaatcggcctgcagatcggtacattgaataagccggtgaaaaatgtcatggtgacactggatgttctggaacaaacggtagatgaagccattgagaaaaaagttgacttaattatcgcccaccatccgccgatttttcggccgcttaaacagatcaccactgatcagcctggcggaagactgattgagaaatgtataaagcatgatattgccgtatatgcggctcatacgaatcttgatgtggcggacggcggtgtgaatgatctgcttgccgaagctctcggcctgacagacacagaagtgcttgtcccgacatattcggacccgatgaaaaagcttgccgtctatgttccgaaagactatgaagaagctgtaagaaccgcacttggcaacgccggagcgggacatatcggcaattacagccattgcgcgttctcctctgagggaatcggcagctttaagccgctggacggggcagaaccgtttatcggacagacgggagaactggagctcgtccatgaagtgagacttgagaccgtttttccggcaagtatggagaaaaccgtcgtaaaagcgctgaaaaaaagccatccgtatgaagaggtggcatatgatatttatccggtggagcagtctccgcttgaaaaaggactcggccgcatcggaaaacttcagcaagacatgacgcttgaagagtttgctctgtttgtgaaagaaaagtttgacgttaacggagtccggatggtcggagagcgaaacagcaaggtgaaaaaagtcgcggttcttggcggtgacggaaataaatatatttatcaggcaaagcggaaaggtgcagatgtttacgtgacgggcgatctttatttccatgtagcgcatgatgcgatgatgatgggattaaacgttgtggatccggggcattatgctgaaaagatcatgagaaaaggcacggctgagaagcttacggcaatggcaggagagaaaaactatgatgtgcgcattttcgcttccgaaacagatacaaacccatttaccttcttataaaaaaactgaggccccgggcctcagtcttttatttttactttcggaaggatttttttaagcggcacactgtgttcaagctgccatgtcgattcatcgttgtggtcaaactgctctaaaaagcggatgacttcctttgtaatcggtgtcggtgttgatgcgcctgcggtaacggcgacggtattgacgtctttcagccattcgagcttcagttcactgatgtctccgattcggtaggcttttgttccggcgatttcttctgacacttgcgccagtctgttggagttattgcttttcggatcaccgacaacaatggttaagtccgctttttttgcctgctctgatacagcttcttgacgaacctgtgtggccaggcagatttcctgatggtattccacgtacgggtacttttctttgactgattccataatatcgtggacgtcccactgggacattgtcgtttggtttgtaacgattaatttctcagcctgaatatcgagatttctcacgtcttcctctgtttcaacgagatgaacgatttcaggagcgacgccgacagctccttcaggctcggggtggccttttttaccgatgtatatgacgtgataaccttcagcttttactttccggattaagtcatgtgttttcgtgacgtccgggcatgtggcgtcaatcgtaacaagccctttttcctcagcggcttttcttacttccggagataccccgtgagccgtgaaaataacggttcctttttccacctgctttaaaatctccagacggtttgtgccgtcaagcgtgtaaatgccgtcttcctcaaacgcatctgtgacatgcttattatgaacaatcattccgagtatatatataggtcttggcagtgttttatcgagtgacgcgtttttggctatgaccatggcatcaacaacgccgtaacagtagccgcgcggcgatattttgataacgtccaatgtagatgtcctcctatcaaaagtgagtgtagaggcaatataaaaagccgtagttaaacggctcaaatcttgcattcttctgatctcattatagctaatctttcgtgagatatcaaagaatgttaaatatataatttcggctttgatctgcccgatgttctttttggacgcggctgttccgctgagtctgcctgtgcggcgtctttttcttttgaagcggatgctttttcagacgtcttctttgatgttttggatgaggcgtctgatttgttttcatcttctgtttcatctgttttttcagcttcatcctttttgtcctgttcgtctgtttctttcgtctcgtcagattcattctcgtcatcactgctgcttaattggctgtaaagcttcatcatggcgggcagactccgtactaaaggaccgtactgctggatcatcggcgtaacctgctgcgccacgccgagcaccttctgaacgttgccgagcatgttcgacagggatgccggacttgccaggttctgtattccctgcagtcctgcacctgctcctccgctggccgccgccggtgccgacgcggcagcgcttcctcctcctgaaccgggtaaaaaacgggaaagcataccttttaagccccctccgccgcccgtgcctgcgtttctcaggcccgctccggcaatctgctgctgagggaaaagctgccggccctgctgcattagctgccgtcccggcaatgacggtcttcctcccatcatcatacgcggattcataaacggccgtccctgctgcgccatatttctcatcggctgctgtggaaacatacttgtacctcctttctgtctctctgctattacaatatgcatcggagggggcatttgcttttctgtctcgaaaacaggattcccccaagacatggtgtttttaagtaaaatcggttataatgtgatgatggacacagaatgtgccgctttaaggagctgggaaaaatgaaagaaactaaatttgatggatacaacttaaaaccgtttattatagatgcagttcaccgccttggtttttatgaaccgacagatattcaaaagcgtctgatacctgccgtactgaaaaacgaaagcgtgatcgggcagtcccagacggggacggggaaaacccacgcctatttattgccaattttgaatcggattgatccgggttctgatacggtacaggctgttatcacggcgccgacgagagagcttgccaatcagattcatcaggaagcactcaaaatcacacagggtgcggaagatgagccgatccggacaaaatgcttcatcggcgggacggacaagcaaaaatcaattgataagctgaaaacacagcctcatctcgtcgtcggaacgccgggccggatcgcggatctgattaaggcgcaggcattgaacgtctataaagcgcagtctctcgtcattgacgaagctgatctgatgcttgacatgggctttttagaagacgttgattacatcggatcgcgtatgccggaagaacttcagatgcttgtgttctcagctacgattccggaaaagctgaagccgtttttgaaaaagtatatggaaaatccgaagtacgcgcatgttgagccgaaaagaatcacagccgaaaagattgaacatgttttggttccttctaaacagcgtgataaagacaaactgctttttgatatgatgtctcatctgaacccttatctgggcattgtgtttgcaaatacgaaaaacacggctgaccatattgcgaaatacctgactgaaaagggcatgaggatcggtcttctgcacgggggattaacgccgcgtgagcgtaagaaggtaatgaagcagattaatgatctggaattcacttatgtcattgcgacagaccttgcggcaagaggaattgacattaaaggcgtaagccacgtcatcaactatgagcttccggacgatctggatttttatgttcaccgcgtcgggagaaccgcacgcgcgggttcatcaggccaagcactgaccatttatgagctttctgacgaagatgcgctcgtaagactcgaaaagatgggtattgtgtttgactatgcggagcttgtaaacggcgaatggaagaaaggcgatgaccgccaccgccgcaaaaaacgcaaaaaatcggagaatgaggctgaccaaatggcgaagcgcctcgtgaaaaaaccgaaaaaagtgaagccgggctataaaaagaaaatgagctacgaaatggaaaagataaaaagaaagcagagaagaaacaaatctaacaaaggaaagtaggggaatcgggttgctgaaaataggttcacacgtctcaatgagcggaaaacatatgctccttgccgcaagcaaggaagctgtttcgtacggggcgaatacatttatgatctatacaggcgctccccaaaacacgcgccgcaaaaaaattgaagacttgaatatcgaagagggccgcgcccatatgaaggaaaacggcatcgatgagattgtcgtgcatgcgccgtacatcattaacattggaaatacgacaaatccggcaacatttgagctgggcgttgattttctgcgttctgaaattgaaagaacggcagcgatcggcgcgagacagatcgtgcttcatccaggggcgcatgtcggagccggggctgagacgggcatcaaaaaaatcattgaaggtttaaacgaagtgattgttcccgggcaaaacgtgcagattgcgctggagacaatggcgggcaaaggatcagaatgcgggagaagctttgaagagctggccgagatcattgcgggagtcacgcataatgaacatctatccgtctgctttgacacttgccacacccatgacgccgggtatgatgtcgctaatgattttgacggtgttcttaacgagtttgataaaatcgtcggcatcgatcggataaaagtccttcatgttaacgacagtaaaaatgtcaaaggcgcccggaaagaccgccatgaaaatatcgggttcggagagatcggttttgacgctctgcagtacatcgttcatcacgagcagcttgccgatatcccgaaaatcctcgaaacaccgtatgtaggcgaagacaagaaaaataagaagccgccgtaccgttttgaaatcgaaatgctgaaagaaaagcagtttgataaggagcttcttgaaaaaatatcagctcaataagaaagaaaggaggggcgggtgtccctccttttttaccctgagaattgattgaaaagttcgtcaactttccgcgccgtttcttttgaagttatcgtttccacttttttcagcaggcgcagccgctcctgttcatcaaaaatattgatgttttttccgtgcatcagagccgctacctcagccgcttgacttcttgtaatgctgatcccgtattgcttggaatatttcagcagatcgtccgcagtgacttgattgagccgctgcaaaataattctttgtattaaaatcatcgatactttcacctctttagacataatgtattgagcagatcattaaaatgttacagcttttaatggtaaaataaagttgcttactgtttaaaatagttattataggaaaggagattttatgaccccaaataaacagcataaaagagaatcatttttacactttatcttcagggtcattatgattctgatcggggcgggttcagccgccgtaagtattgaattgtttctggtccctaataattttatcgacggaggcattatcggtgtttcattaattttagaccacctctttatgtccaatcccctcctcaattttgccttattcgttgtgttactcaacattccatttatgattttcggatataaatatatcggaaaaacatttctcatctctactgttatcggaatcgtcggtttagcgctgattgaatcctcattgcaccatgtggaggccattacgacccagcctattttggcgacggtattcggggggcttttgctcggtttcggggtaggccttgtcatccgaaacggaggctcgatggacggtactgaaatcctcggtatccttctcacgaaaaagctgcccttttcagtcggggaattcgttatgctcatcaatgtgtttattttcatttgggccggttttgtgttcggtccggagcaggcaatgtattctttcatgacttattatattgccatgaaaacgattgacgcggtcatccaggggcttgatgaaacaaaagcggtcattattgttgcagagcaatatgctgagatctcagatgcaatattgcaccggcttggacggggaaccactaagcttcagggaaaaggcggatatacggatgaaaccaaagaagtcatttacgcggtcgtgacaaggcttgaagtgactaaattgaaatccattgtgtttgaaattgataaaaacgcctttattacaatcatgaatacccatgaaacgaggggcggtaagttcaaaaccgcgattcactaggctttcatttacttttcatcattttataggtataatttgatacatcataagaaaatggcctgctgttcagacagctgccattttctttttggagcgataccgtgttgtaaaggggaggtcctcatgaacgtacaagaagcgttgaacctgctgaaagaaaaagggtataaatatacgagtaagcgagaagacatgctgcagctttttgctgattctgataaatatctgaccgccaaaaacgtgcttgccgcattaaatgacgactatccgggtctgagctttgataccatatacagaaatctttcgttatatgaagaactcggcattttggaaacgacggagctttccggagaaaaactgttccgttttacatgctcttatacccatcatcatcaccattttatctgtttaacctgcgggaaaacgaaggaaattgagtcctgtccgatggataagctgcacgatgatttggaagggtatgaaatcagcggccataagtttgaaatttacggcacctgtccggcgtgccgataaaaaacctcctgcttatacaggaggttttttcagcttttgacatgctgaaagctatgtttgtttttattaatccaggcgacggcttcaagccaattctgcaccctgataatattggaatcgatggggagctgattatatggggagttaaaaaggataaccggaatgcctgcttcttttgcgatcattgtcgcattgccgtggtgatcttcgaaaaataaatcaatgccgtgttttttgacggcttccactttgtgatggcctccgacaagctcaatgtgatcgtaatgaatgtcccggtttgcaaaccagtccagcgtaacatcttctaagtggccgcgtcttgccgtaatgtagatcaggcggtgctcttctttcagtccgtccagtgcctgcttggcaaattccgcgagcttcgcttctttatatatggctgcttcatgaacgttcatccattcccaaaattcctcgtctgtaatgttcaaaagcttcgtcagatcataatcagtcatatcatccaaggtaatggaaagatgaaatgagcggtttaaataagggacaaatgtatcctgtgccgtaactgtgccgtcaatatctatacctaaccgtaacatgtccacactcctataaattcatcccttcaagtgtaacataaacaattaacaataccagaaaagtttagcaaacatgaattcgtaaaaaacgcggaaactaaaaaagctcctttcataaaagaaaaagggggaattgaaggtggcatacgattacgaaaatcgaaaaggcaacgactactacgtggatcatggatcggaaggaaccgatatcacgcgtgatgtttattcagaagaaacagcggccgaaatttcagagccatatcgtgcttctgaccgggcagcagaccgtgatgataatcgggacggagtaagtgaaggccgggggatagggtatgcagcattggctatttctatcatttccctgtttgtgctccctgttttattaggggcatgcggcattatcgtcggctatatcgccagaagaagaggagcaggcgctttaggcggatgggcgatgggaatcggtattgtttcccttgtgctcggcatcttcattacaccgtttttttaacacaacgcaaaaaaagcttggcggaatatccgtcaagctttttgtgtttcttgttctgcttttgctttttccgcttcaagctttgcgtagtgttcttctgccagcttgtcgatttcttttttcagctcttcgaccatggtttcttcagggactttgcggacgatttggcctttgcggaaaagaagtccttcgccgcgcgcgccggcaatcccgatatcagcttctcttgcttcgcccggtccgttaacggcacatccgagaacggctactttaatcggcgctttgactttagaaatgtattcttccacttcatttgcgatgctgatgagatcaatttcgatccgtccgcatgtcgggcatgaaataagcgtagccgcgtttgaagcgagaccgaatgatttcagcagttctctggctacttttacttcttcaaccgggtcggcgctcagagagatccggagcgtgtttccgattcctttgcttaaaatcgctccgagtccggccgcgctttttaccgttccggcaaacagcgtgcccgattctgtaattccgaggtggagcggataatcaaatgcttttgatgctttttcgtatgcttctatggctagattgacgtcagacgctttcatgctgacgatgatgtcgtgaaagtcaaggtcttccaggattttgatatgatgaagcgcactctcaaccattccgtcagcagtcggatagccgtatttttctaaaatgcgtttttccaaagaacccgcgtttacgccgatccggatcggaattcctttttctttcgctgcttttacgacggcttccactttttcgcggcggccgatgtttcccgggttgattctgattttgtcggccccgccctcaattgcttttaatgcaagcttgtagtcaaaatgaatatcgacaacgagagggatggaaatttgttttttgatgtcggcaatcgcgttagcggcgcgttcgtccggacatgccacccggacaatttggcagccggcttcggctaaacggttgatttccgcaactgttgcttctacgtcgtgtgttttggtcgtcgtcatactctgaatgacgacttcgttatttccgcctattgttaaaggtcccactttgacgggacgcgtttttgtacgatgtgtgatttcactcacttgtcaatcgctccttaattgtagttaccgcttttgcaggctgagccttttacatgtcaggcaacttctatttacatgttatattgtaacagtgtatttgccgaactgacaagaaattaacgtttaattgcggtagacggggaatttataagcggtgcctgcctgaattgcgtttgcttttacattcggattcagcgcttcaaaatcttgcgcaatatcatctggcgctttatgtgcgccgactatcgacatcaccgtatcgccttttttgaccgtaaccgttctgtatgaagattcctgtcgggctggctgtgctgccgctgcgtatgctggaaggtcttgagaagggatcgtgccgattttaagatcgtaaaagataatgaatatcacaaataaactgccgaatacaaaagtaagccgcttcattccaaccgcctcccgcatacatttttacttcattgtatgcttgtcccattttgttcatgacaaaaaagaagaccgccgggggcagtctttgttacacagctgtttttcttggcggtatctcttttaagacgaggaaaaggatgataaagtttacaaaccaattcactaaaaattcactcggcaccgtaataacaagcgcgcgcatgatcgtaaagaatatggtcgaaagtgtaatggaataagccgaaagcttccagagctgctggtaattcaatgtctttctttgcgcatttttcaatatcaggccgatgacggcgagaaatgatacttcaatgaattttccggccgctgtcatgatgaacagcaaaatggacaggacagtgacgatcattgttttattttggtttaatgctgatatgatttctttttttgtgatatcagctggcatcagcgaataattcatttctgtcgcctgtccgtctacagcaagcaccattttatttttcaaaatgccgatcgcattttgtttcgccgctatttgtttcgcgccgtaagcatctgtcggatcaaacacgatgacgaacccgttcgcttccgtttccttagaggcggatgctttcgtctgcaattctccgtttgaaatgctgaaatcagggaaatctttctttaacacggttttgaaaccgttcattgagtttacggtgcctgaggaaaggtaataagcgcttggcagcgtaaaaaggacagacagcaaaaatacataaaggatcgcttttcctatcccctgaaaacgtgtttttgcaatatccgccggagagtatgtacttttcaataaagccgtaaatatgttcaacatcttcacttcctagcctaaactggtatatgttgcttattgtatcgttcacaggggatgaacacaagtgagagtatttaaagcggtgataaggaatcatacataataagataaagcgggaagcggtgatcgcccgcaaaacaaaggagggtgtttttttcatgagtgttttgtattggctgattatcattgcggtcttcgtcattgcttttatcgggcttgtatatccggtgattccaagcgttatttttattgtggccggttttcttctctacggatttttgttttccttcagtccttattcttacctgttttggctcattgaggcggtatttgcggccgttttattcgcagctgactatgtgtcaaatttacttggcgttaaaaggtacggaggaagcagggcggcaatctggggaagcacgatcggattattgatcggacccttcgttattcccgtggcaggcattatattaggcccgtttatcggtgctctctgcgctgaggtgtttgttcatcaaaaggatatcaagtccgcggcaaaagtggggctcggctcgttaatcggctttttaacaagcgtggcggcaaaaggcgtcattcagctctttatgatcgggtatttcttatggacggtgctttagaaaggtttaatttcggccgtgaacggataaagtgtaatatgtctgctggaatcgccggattgtgagctttttcattgattaccacgctttcttttgttacattgagattagaaaagttcgcgttaagcggcatttcagtacatatatttaaaggaggaaaaaattatggcttacaaacttccagaattgccttacgcttatgatgctttagaacctcatatcgataaggaaacgatgacgattcaccatacgaagcaccataacacatacgtgacaaacctcaacaaagcgatcgaaggatctgcgcttgcagagaaatctgtagatgagcttgttgctgatttgaacgcagtgccggaggacatccgcacggcagtccgcaacaatggcggcggacatgcaaaccactctttattctggactcttttatctccgaacggcggaggcgaaccgactggtgagcttgctgaagagatcaaaagcacgttcggaagcttcgatcaatttaaagaaaaattcgccgcagcagctgcaggccgtttcggttcaggctgggcttggctcgttgtaaacaacggcaaacttgaaattacaagcacgccaaaccaagattcaccgctttcagaaggtaaaacacctgttctcggtcttgatgtttgggagcacgcgtactacctgaactaccaaaaccgccgtcctgattacatttcagctttctggaatgttgtgaactgggatgaagttgcccgtctttacagcgaagcaaaataattgagttgaatgatcacaaggtctcccgcgggaggccttgtttttttattgactttgattccttttacatatctcagtttgagtgagacaaactaatgtgtagtaaaggggagtcaatgatgagcaaaataaaaaaaattatcggcgacatcgaaataaataaagggctgctgctgttattgacgattggcggcctttactcattgggcatcgcgctgtcaaatacatttgtcaacgtgtatttgtggaagcagtcgggaaaatttattgatttggccatatacaatttgtcggtcgtaacgatgcagccggttacctttctgctggcgggccggctggctaaaaaaattgacagggtgtttattctaaggttcggcgttatctttttggccgctttttatttaagtgtgctgcttgccggagaaactgcggcttcccgtctcgttttgataggggccgtgctcggagttggatacggcttttactggctggcttttaatgtgctgactttcgaaatcacggaaccggaaacgagagatttttttaacgggtttttaggcattttgtcttcatcggcgggcatgatcggtccaattgtggccggatatgtcatttcaagacttgaaaacaatacgggttatacaatcattttcagcctgtcgctcggcttatttgcccttgccgtggtcatgagcttttttctgaagcggagggagtcgaaaggccggtttatgctgaaaaaagtttttgatgagcgccacacgaatctgaattggcgccggattaccaacgcgcacttttttcaaggcttgagagaagggatttttgtttttttaatcagcgtatttgtattcattgcgacaaacagtgagctggcgctcggaacattcggtctcgtcaattccgcggtttctttttttgcctattattttgcatcaaggctcatcaaaaaaagagcgcggaaaaaggcgattcttatcggcggattgatcttgtacggcgccctgtttctcatcatttttaaaatgagcttcacgacgctccttttgtacggagtgtttattgcgatcggctatccagttcttctcgtgccgtatgtctcgcttacatacgatgtgataggccgggcgcggcttgccagaaaagccagaattgaatacattgtgctcagggagttatttttaaatgcgggccggatcgtttccatcctttgtttccttgtcatcgttacattgttcaaggaaaaagtgggaataccggcggcgctcgtgctgctcggagccgggcatccgctgatttattactttataaaagacatcaaactggacacggaaacttctgatgaaacagtggaagaagaccgacaaaaacgggcggcggaaccgaattttataaaaggagaaagataaaagggttatctgtagaaaaatatcgaaaaaacctttagaatgaaaaatggcacctgaacagaaggtgtcatttctttctgtaaataagaaaaggtgatgtcatgaggagaaataaaaagaaaatagctgtaaacaaagaaaagaaaaaatcactgccgatccggcttaattttttgtttttggctgcgtttcttattttcacttggattatcgtcgagcttggcatcaagcagatcgttcagggtgatgattataaaaacgccgctaataagcaggaggagtctgatgtcagcacggcggttccgagagggaaaatttacgaccggaacctaaatcccatcgtaacgaataaagcattaaatgcgattacatatacacgttcagcctcaaccacccaggcgcagcgtttgaaaatcgcaaaaaaactgtcgggtatgattaaggtaagcaccaaaaaggtgactgagcgggataaaaaagactattggatgttaacgaggcctgatgaagcgaaaaaactgattacggccgaagaaaagcaaaaagctgaagacaaaaaactgtctgacgatgatttatatcagcttcagctgaaacgtatcacagacaaacagctgaatgagctcacttcaaaagatatgcagatccttgcgatcaaaaggcagatggattcaggctactcactgacgcctcaatacatcaaaaatgaaggggtgtcggcaaaagaaatggccgtcgtcagcgaacatttggatgaactgccgggagttgacgtgacgtctgactgggaacggtcttatccttataaaagcctgatccggacattgctcggcagtgtatccagttcgaacgaaggtcttccgtccaacctgctggatcactatctgtcacttggctacagccggaatgacagggtcggaaaaagctatttagaatatcaatatgaaagcctgctgcaggggcaaaaagagaaagtgcagaacttaaccgactcatccggaaatgtcacgggcagcaaagtgatttcaaaaggacaggccggcaaagaccttgttttatccattgatatggacctgcagaaatccgttgaaaaaatcattgagaaaaatttaaaatcggcaaaagcgagaccgagcacgaagcttcttgatcgggccttcgtcgtcatgatgaacccgaaaaacggagaagtgctgacgatggccggcaaacagattacgaatgaccatggaaagtacaaaattaatgattatgccctcggcgcaatgacttcctcctacgcaatgggatcggcggtcaaaggagcgacggtgttgaccggactgcagacgggcgcgattaatttgaacaccgttttccaggatgaacctatgtatttcaagggaagtaaaaacccgaaaaaatcatggacgaatttaggtcccgtagatatccaaaaagcgcttcaggaatcatcaaacgtgttcatgttcaaaacggcgattgccgtcggtaaaggggagtacaaaaaaggccagtccctgccgcttgatatgaaggcattcgatactttcagatactacttcaatcagttcggactcggagttaagacggggattgatcttccgaatgaagcgaccgggtaccaagggtcacagcgaatttccggtcttctgttagactttgccatcggacagtatgatacgtttacaccgctgcaaatggcgcagtatgtatctacaatcgccaatggaggctatcgtttgaagcctcagcttgtaaaagaggtcaggcagcctgattcgaaaaaaggaatcggagccgttgtagagtctgttcagccccaagtgctgaacaagattgatatgaataatgcagacattaaagaagtgcaggcaggtttcagacgcgtcatgacaaaagggacagccgcaactgattttgcgactgcgacttacagtcctgccggtaaaacgggtaccgcgcaatctttctatgacggtcctgacaaatcagagacgggtgaagcaacatataacacgactcttgtcgcgtatgcacctgctgataatccggaagtggctatttctgtagtcgttccttgggcctatattaattacagcgatcgatattcgattacggatgatataggaagagcagctctggacaaatactttgagctgaaaaagaagcaagaagataataatacgaagcagaaaaacgaagataaaattcaggaagacgctgaaaacggcaatacaaacaactaatagaaaaacgctcacaatctgtgagcgttttttttatacaaaaaaacatccggatttacaaaaccttaacacttgatttatacgcattttacaagaaccctttactctagacctgtaggacaaattacacattaaatgcagggggaattcaggaaatgaaaaaaaacaaatggatgcttatgcttctgatggctgctgttatgattgttgctgcagcatgcggaaatgcaaaggaaagcggcaagacagacagtcaatctgcaagtgcggataaaaaagcatcaggttctttaaccatttctggttcatcagccatgcagccgttagtactggcagcggcggaaaagtttatggaaaaacatccggatgctgatgtgcaggtgcaagcgggaggttcaggaacaggtctttcgcaagtgtctgaaggggcagtgcaaatcggcaactcagatgtctttgctgaagaaaaagaaggcattgatgcaaaagccctaaaagaccaccgagtagcggtagtggcgatggcggctgcggtcaaccccggtgcgggcgtaaaggatataaccaaaaaacagctgacagacgtctttacaggaaaaattaaaaactggaaagagcttggcggtaaagatcaaaaaattacactcgtgaaccgtcctgattcatcaggaacacgcgctacgttcgtcaaatacgcgcttgacggagcagatcctgctgagggcattacagaggattcctccaatacagtcaaaaaaatcattgcggaaacgccgggagcaatcggttatctggcattctcttatataaacgatgacaaagtaacgcctttatcgatcggaggcatcaaaccggaagagaaaaacgtcgtcacaggcgagtatccgatttgggcttacgagcactcttatacgaaaggtgaagcgtcaggccttacaaaaacgtttcttgactatatgaacagcgatgaagtacagaaaagtatcgtaaaagatcaaggttacattccgatctctgatatgaaagtcacacgtgacgcaaacggcaagcaaagctgaggggagggcgggctccccgcctcttcttccttataggagtgtaaacaaatgataaatcacagagaaaaagagtctgtaagcgaacgcttaataagctcaaaacaaaacaggcaaatggatgaagtccgcggaagggtgattgtgtctgtgtgtgccgcgattatcattgcggcatcagcggcgatcacaatttttctcggcataaaggggctgcaatctttttttgtaaatggtgtaagcccgattgagttcttaacaagtctgaattggaatccaacccaggcaaaacctgagttcggcgcgctgccttttattttcggatcatttgcggtcacggttctgtccgctctgatcgcagcgcccctcggtattgcgggtgccgtgtttatgacggaaattgcgccgacttggggaaaaaaggtgctgcagccggtaattgagctgcttgtcggcattccgtccgtcgtttatggattcataggtcttacagtattggttccgtttatcggctcttttaaatcaagcggaacgggtcacagccttctggcggggacgatcgtactctcggtaatgattctgccgactgttacatcgatttccgctgatgcgcttgcgtcacttccgaaacaccttcgcgacggttcatatgcgcttggtgcgacgaggtggcagacaatcagaaaggtgcttatcccggcggcgtttccgacattgctgaccgctgtcgtgctcgggatggcaagagcgttcggagaagcactcgccgtacagatggttatcggaaatacaaagcttctgccggaaagcctgcttgatacggcgggaacattaacgacgattattacgttaaacatgggccataccacatacggcagtattgaaaataatacgttatggtctatggggcttgttcttctcatcatgtcgtttctgtttatattgctcatacgctacttgtcgtctaggaggaaagtgtaatgaaccggaaaataacggataaattggccaccggtgtattcgggttatgcgccgctgtaattgcggcgattttggcaggattgtttttgtacattcttattcacggcgtctctgaaatctccttgcattttcttacgtcaaaatcgagcgccattgcgtcaggcggcggaatacgggatcagctttttaattccttttacattctgtttatcaccatgctgatcacgataccgcttggtgtggggggcggcgtctttatggctgaatatgcgccccaaaataaaatcactgattttatcagaacgtgtattgaggttctgtcttcgcttccgtccattgtcatcgggatgttcggcatgctgatgtttgtaaacctgaccggatggggctacacgattatcggaggcgcgctcgcattaacggtctttaaccttcccgttatggtccgggtgacagaaggcgcgctcactgcagttcctaaggagctgaaagaagcttctctcgctttaggcgtatcgagatggcataccgtcaaaacggtgctgattccgagtgcgattccttcgattttaaccggagccattctcgcatcaggaagagtattcggagaagcggccgcattgttatttacagcgggactgacaacgccgcggctgaattttacggatttgaacccgttttctgaatcatctcctttcaacattttcaggccggctgagacgctggcggttcatatatggagtgtcaatacgcagggaatcatccctgacgccgaagcgattgcaaacggcggctccgcggtgctggtgatttcggtgctcttgtttaacctttgtgcaagatggctcggatctgtcatttataaaaagcttacggcaaattaatcggaaagaggcgaaaacatgattgatcacatcatcagggaacaagcggaacagacaaagcgttcgccggagtcttcaattttggaagtgaagcatttatcaatttattacggtgacaaacaagcggttaaagatgtaaacatggatattgaaaaacatgcggtgacggctctgatcggtccgtccggctgcgggaaatcaacatttttgagacagattaacagaatgaacgatgccatcccttttgcaagaagcgagggagagatcctttatgaggggctgaatattttgggggaagcgattaatgtcgtgtctctcagacgggagatcggtatggtgtttcaaaaaccgaatctgttcccgaaatccatttacaataacatcacacatgcgctgaagtatgcgggggaacgcaggaaagccgttttggatgatgcggtcgaggaaagcttaacgaaggcggcgctttgggatgaagttaaagaccggcttcattcatcggctctttcgttatcaggcggccagcagcagcgtctttgtatcgcccgtacgcttgcgatgaaacctgccgtacttcttttagatgaaccggcctcagctctggaccctatttcaaacgccagaatcgagacgcttttgacagaactgaaaaaagattattcgattattatcgttacgcataacatgcagcaggcgctgagggtgtctgaccgaacggctttctttttaaacggggaagtggtggaatacgggcagacagaacaaattttcacgagtcctaaagcgcaaaagacagatgactacattaacggaaagttcggatagggggaaggactgtgagccttgtgaaggaagcggtgcacacacagaatttatttgatattcacggcatgaacgtatggtacggagcccaccaggctttaaaagacattacgatcggttttgaggagcggaaggtaactgcgatcatcggtccgtccggctgcgggaaatccacttttattaaaacattaaacttaatgctgcaaatggccccgaatgtcaaagtgacaggcgacatgatctataacggacgcaatctgctgaaagaaaagacggatgcggcagaattaagaaaacagatcggtatggtgtttcaaaaaggcaatccgtttccgcagtcgatatttgagaatgtcgtgtacggtccgagaattcacggcgaaaaaaataaaaagaaactgcttgaaatcgccgaggaatctttaaaggccgccgcgctctgggatgaagtgaaagatcgccttcaccagcaggcgctttcactgtcaggcggtcagcagcagcggctgtgcatcgcaagggcgctcgccacaaaaccggacgtccttctgatggatgaaccgacgtccgctcttgatcccgtgtccacgcggaaaatagaagagctgattttgacattgaaagaaaagtatacaatcgtcattgtgacgcacaacatgcagcaggctgcgagggtctctgatcaaaccgcgtttttctatatgggcgaactggtagagtggggggatacgggcaaaatattttctcaaccggatcatcaaaaaacacatgattatatcaccggaaaattcggatgaaaaaaacgggcccggccattgaccgggtccgttttatactgcctattaaaaaagcctgccggccatatccatctgaatggacgatgcctgcaagcttttttagcgggttaatgttttgacgatttttttaaagctcatatctgagtcgactttgaaatggccggcgcggatttctttatggtaacctgcgtcaatgacgtaatcattaaagtccttcgctgaaggaataatcccttctttttcaagaatggatgacacatcagcagtgctcattccgtctttaatcgtcagtttgtatgttacttttttctttttggcgtctgtgttttggtcgttgtttaacgatttttctttagaatcaagcagtttttgatagtcatcccggttgacggagactttttgctgatcgtcgaggtagctgtttacttctttctctgtcaatgctgttttttcggttttaacggcggctgcctggtcatggtcagtcaaatagaagacagcagcgagaacggccgtcgctaaaatcatgcctgctgcaaaagcctgaatgccccgttttgtcatacgagcaccttctcattatctttaataatggtattgacgtcctcgacagacacgtgctccgcttttgcgatggcttccgcagacattccgttgttatattttgaaatgatttgtttggcgattttttggttaatgccgctgcttttggctttgcggatcacgaggttggtttccagcaattcttcttcaagcaccgtcattttctttttcaacttgtaaatttcctgcatggcggaaagctgaagcgtttcaagctcctgttccacgtctttcatcggatctctttgagaatatgagaatgcaataagcgctatactgacgataaacaacgcaataatagcaatttccacgtttcatcaccttctattattaatttgcccttcttttttataccataaaacgccgccattctaaaggaaatagagaaaaaaacggaattttgtcgggaaatcttttttattcggggagcaaacggttatttctctatagatttcgtatcagaaagcccttttttgtcctgtttcgtcatattttcccttcatctgacgcaagctcattcagaggatcagaagcataaactgatgttttctgcacttaaacaacatttcatgtaaatcactctagcattccgtccattatagtggtattatgtataagtctgaataagtaaatgatatttagtttggagggaaaataatgcgcgttaatattactttggcttgcactgaatgtggtgagcgtaactatatttctaaaaagaacaaacgcaacaatccggaccgcgttgaatttaaaaaatattgcccacgtgataaaaaatctacgttacaccgtgaaacaaaataagctgtttaaaacagcggaaaaagctggagctttcaataaagttctggcttttttgtctttcagggaggtttgagaaacgtgaaagcacaaatcagaaccgatatcaaagcaaagctttctgacatgacagaaagtgaatgggaggcaaaatgccgcagcatgcgtgaaacgctgttttctttaaaagaatggaaacaggcccgcgtgatcgccgttaccatctcgacacgcctggaaattccgacacagccgattattgaacaggcctggaaagagaaaaaacaagtctgtatcccaaaatgctttccgcagacgggagcgatggagttccgtacattttctgcgtatgatcagctggaaaccgtatatgcgggcctcagtgaaccgatcgagagccagacggaaaaagccgcccaaaaagacattgaccttgtgattgtgcccggcgtggcttttgaccgggaaggcttcagaatcggatacggcggaggatattatgatcggtacctctccggttataaaggccgtaccgtgtcgcttctctttgactgccagctgacagaccgcattccccgcatgccccacgatattccggtcgatatgatcgtgactgaatctgaaaccatcgcttaatcgcataaaaaacttcttgcaccggaataattctcgctgtttgacaaacgataggggcaggagggataagatgaaaaaattgttgatctactcattatgcgccgtatctgttttagccgtttaccaaaaccgctaccgtctgatgaacagcgtgctcagccagccggggatcagacggtcattcattcatttctttttaaaaataccgtttatcagaaacaaattcattcagcaggcattttaaacaaatcccgtttttcagcgggattttttgcataagaaaacctgccggtaaaaaacggcaggttttctcgtattgtcagctttttttcaggaaaccgagcagaattgagatcataggagaaatgtacaggaaaaaggtaaacggcaggtagtcgatgacggaaacccctaatgcgcttgccataaaagcgccgcttactccccagggaatcagcgggttgatcaatgttccgccgtcctcaagcgaccgcgcaaggtgaatccgcttaatgctgagcttgtcatataaaggtttataagattgacccggaattaagatcgacaaatactgctcacctgtcgcaaggtttacgcctatacttgagaagacggtcgccatgacaagacgtcctttcgtatgcacgccttttatcaatccttgaagcagcgccgcgatcaggcccgttttttccatcaggccgccgagcgcaaaggcgatcatgatcagagagactgatcccatcatcgattggagcccgcctctgttgataatgctggccacagcctggtcgccggttttaaacgccgtcccgctttgcagggcggatataaatccttgaatgctgctgtcaggaataaaaacagcagtcagaagccctgcggaaataataccggcggtaagcaccggaatcacggaaacccgtctcacagctaaaatgatcaccaacagaggtgaaagaagcgaccaaggcgtaacgtgcacggcctcttttattccggaaatgaccgcctcaatattttgcgttgaagcggcatttattgaaaccgatgaaccgagaatataaaaaagaacaatcgtgatcagaagtgccggaacggtagtgcccatcatatggcgaatatgcttaaaaatcggaatttcgccgattccggcggcaaaattcgtcgtgtcggacatcggtgacattttatcaccgaaacaagccccgcaaatgactgctcccgccgtccattcgagcggaactcccgccgcgcttgctacccctaacagcgcgacgccgattgtactgacagttgtcagacttgagccgacaagcgtgctgataatcatgcaggaaaataatgcggtcaaaagcagctgactcggctgtataattgacaaagcgtaaacggtgacggtgggaatggcgccgctgtacatccaggcgccgatcagcacaccgatcaaagccagcacgataatcggctgcacaccgtttttcaatccgctgacaattcctttttcaagactgtcccacgagaaaccgagccacaaacctgccagagacagaataatgacgcaaaagaacagcggcatatgcggctctgtatgaaagaaaaacaggcaggaaataatgactgctaacatcaagacaaataaactgatggctgagatgaacgtcagccttttttcttgtttcaaaacaacaccccatcaaactttaatccttttgtgcttttgggcacgaaagtattgtaacagaaaaacgcataaatgagtgtttttttacaattgtgaatatacaatttatgaaaataatacaaggatattttctccaatcgttttttgcttgacgcccggatcagtgatgaaatacgcttatactaagaagaatagaaatggtgaagaagatgaattcattttatgacgtgcagcagctgtttaagtcattcggacatatcgtttatttcggtgacagacaagccgaaattgactttatgaaagatgaattaaaggaaatgtacttgtcaaacgtgattgaaagagaattatggcaaaaagccgccggagttcttcagagagaatcggagcggatcaaaggcagataacacagcaggattttaataagaaaaggagattattatggaagatacatggtttgcggggattgatcttggcggaacaaccatcaagctggcctttatcaacatgtacggtgaaattcagcataaatgggaagttccgaccgataaatcaggaaacacaattacggtcacgatcgccaaagcgcttgaccagaagctggaagaactgaacaagccgaaacggatcgtaaaatggatcggaatgggagcgcctggacccgtggaaatgacgacggggatggtctatgagacgacaaatatggggtggaaaaactatccgctgaaagaccatctcgaggcggaaacgggtattccggccgtcattgaaaacgatgccaatatcgcggcgctcggagaaatgtggaagggtgcaggtgacggggccaaagatgtcattttagtgacgctcggaaccggagtcggcggaggcatcatcgtcaacggagaaatcgttcacggaaaaaacggggccggcggagaaatcggtcatatttgcagtattccggaaggaggagctccgtgcaactgcggaaaatccggctgcatcgaaacgattgcgtccgcaaccggcatcgtccgcatcgcgaaagaaaagcttgcggcggtttccgactcttcgctcttacaagtgcgcgatctgacagcacgtgacgtgttcgatgcggctaaacagcaggataagacagcgcttgaagtcgtcgattatgtcgcaaaacatttaggcctcgtgctcggaaatctggcaagcgccatgaatccgacgaaaatcgtgctcggcggaggcgtgtctaaagcgggtgaaatcctgcggtcaaaagtggaagagactttcaaaatcaccgcattcccgcgttctgcggaagcggcggatatttcgattgcggcacttggaaatgacgccggagtcatcggcggggcgtggattgccaaaaatgaatggctcaaacatcaaaactgctgaagaaagtctgcctgcccatatcgcgggcggctttctttttttatctccccagtcatatagttttaaaaaagggggatgaacatggcgggaattcgtgtcaaacctgaattgaaacagcatatgaaagatattgcaaaggtgctttcaattgatgaaaaactgttgaaagccgctgataaaacggcggaaaacgatgaattattttgtcccggctttgccgtgagcgggcagtcagagggtccgccgcttgagacgctgagcgggctttcgcgatacatccggcactgtgaaaggattctttccgctgatcaatgggtgaaggaagaaaaggtgtacggctccgaatcggtttatgaagaaattgagaaaataacggatgtctttccgtttgtcacgtgccgtaaaatcggcagttccgtattgggaaagccgctttatgagctgaaaataggtgcggatacggctgaaagaaaagtccatgtaaacgcctcatttcatgccaatgaatggatcaccaccacggtcgcgcttaaatggtgtaaagaatattgcgcggcattatgcgaaaataaaaccgttttcgggcactctgcgcttgatatattcagcctgacatcattgtcattcgttccgctcgtaaatcccgacggtgttgatctcgtactttacggatgtgaagatttatcagaaaaaaatgaatttcttaatcgattaaatgaacaccgccgggatttccgcgaatggaaggcaaatataaacggtgtggatttaaataaacatttcccatccaattgggatattgaacagaggcgcaaaccgaaagccccttcataccgtgattttccggggacggcgccgctcactgaaccggaggcgcaggcgatgcaccggctgataacggagcagccgcctgaccggctgatcgctcttcatacgcaaggagaagagatttattggggatacgaagaatgtgaaccggagcaatcatcccggatgattcgggagtttgaagcgataagcggaaaccgctatcaaggcgttaaaaccattgacagccatgcgggttttagggattggtttatacagcagtatggaaaagagggctataccattgagctcgggaagggaaaaaaccctttgccttttcatcagtttgctgatatttatcaagcgacggaaggtattttgtggaggtcgcttgttttttgagacatctgtgaaatttctcatttgtttacataaacaaatatgggacaatagaaaagaatggagggaaggctggtgagatacttggtttgtgttctgctgtccgcattcgttctgtgtttagcggcctgtgaaccatctcatcagcagcaagacacaggcgtttcggcaaaatcggcagaacagaaaatcgttccgctcagtaaaaaggaagcggagaaaacggaaggatggctggataacagaacgatcctgtatacagcacatcatcagctgatgaaatatgatcttttcagcggaaaatccgaacggctctatgaaacaaagggcaatattgtcaatgtaaagatcagccggaaaaaacagctgattctcgtacaggtgacaagcagcggtcagactgagcttgtgcttatgaacaagcaggggaaaagactttatcacaaagcctttaactcttatgaactggagacggcttggaatccgtatgacccgtatcaaatgatgattaccgtttttactgaaacatgggacttcactgcctatacggccgatatgaacaacggcattttaaaaaagagtcccgttcaggctccttttgtccattggacctccactgatgaattccaatatatcaagcaaggaaaaacggaggaagagggtcctttatattcttatgacttgcagacaaaaaaagaaaaaagagtgcttcatcacgtcatctgggccgattcccgcccgggcatgacgattgccgtcagacaaacggatcaatcggacggagacggcgagttccttttccaaaagccggcatccgtgacgcaccgctttcctctccaaaaaaagtatcagagctttgcgccgatggaatatgattacgatcagacacacaagcggttttacatattcaagcctgaaggccgctcttacaatctgatcagctttgacttaggagacgaacgggagcggacggtgctcaaaaacacggaaatggagccgattcagatctctccgaacggggaatacgctttatacggctttacgtatgaccgtctgatttcactgaaaacaggcatgacagaaccaatcataacaaatgaaaaaggagtttgaaccaaatggcaattgcagatgtgacaatcattccgatcggaacaaaaacaccgagcgtcagtgagtatgtagcggatgtgcaaaacattttggagggttacaaagctgccggcaagatcaaatttcagctcacgccgatgaacactttgattgaaggtgagctgagcgacttattcgcagtcattcaggacattcacgaagccccgttccaaaaagggctgcacagagtggcgacaaatatccgcattgatgacagacgtgataaagaaacgacactggagagcaaaatcaaaagtgtcagcaaacatttgcagcaataaaaaataagcctgtatccattggatacaggcttttaatgtgcagtcggatagccgctggttacaacggtcattacggtaaaccagccaaacacgcccagcgtggcggcggctaacaaaaatcccaggatatttctctgtctgacagcccgcaggactcctaatacagctaataatgcgacaaggccgaagattacaacaagtaacatcatgctcctcctttgtcattggaacctgaaaatctttccatttcattttaaccgttttcattttgtttgtcgatagcgttttcccggccgcattcattgaatcttccgcagaaaaccttcataataagggcatatacataaagaggtgatgaaagtgaaatggagacgaatgccggccggtccgattcaggcaaacgcgtattttcttgtcagtgaggatcagtcctgtcttatttttgatccgggcggagaagcggacaaaatcaacaattacataaaagaaaacaatctgaagccgctggccatcttactgacgcacgcccattttgaccatatcggcgcgcttgacgaagtaagagacagatgggatgttcccgtatatcttcacaaaaatgaagaaaagtggctggaggactcttccttaaacggatcgggcatattgcgtggcatcgccgtaacggcacggcccgccgaacggctcatcgaaggcgacggcatattggacatcgggcctttccatttggagacattgtttacgccgggacattcaccgggaagcgtttcttattatgtgaaggacgcggatctggtgatttcaggtgatgtgctctttcagggaggcatcggccgcactgatttacacggcggaagtcaggacgtattgcttgattccattcatcaaaaactgctcacgcttcccggatatacacttgtgttaagcgggcacgggccggaaacggatattcagacagagcaggagcgaaacccgtttatcaatggtttttcactgtaaatgaaaaaagacagaccataatcggtctgtctttttctgtcagtgggttccgccgcccggtgtcataataaaaatagagtaatatgtaaatccggcgaaaaatacggttaagtaagctccgaaaatataaatatacatccgctcagtcagattcaaataagaaagaaatacgaaaaagatcgtctgtccaaaaaacaaaagtgaagcgtctttcatgccccctaaaaaaaacatgactgcaaatatccccgtccaaaatcctaacacccggaacatgcgattcattccttatcccctcccgagagtctatctgaagtttattataatagatcggcactcgaaatgtaaacattttcatgattatatttattgtggaatttatgtctttccctgtgttttatatcttatgccgccctctgaaaaagatccgaaaaatctttttgaaatatgtttaatgaaaaaaagttcagggtacttatgttaacaaagagacggattatccgagggaggaatttttaaaaatgaaagaacttattttttattcatacccgagctgcacatcatgccgaaaaacgaaacattggttaaaagcccacaatgttgactttcaagagcgccatctattcagggagacaccgacaattgatgaattgaagcagatcttatcattaacgactgaaggaattgatgaaatattggcgacgagaagtcaaacatttaaaaatctcaacctgaacattgaagaaatgactgtaaatgaagtgctgaagcttttgactgagaagccgaaactgctgcggcgtccgattctgatcgatcgaaataagctcgttatcggatacaatccaggagaactgatgaagctgacgaagaaaaaaacggtacatcaatctgtatcataagagaaaaacgaagatccgctgatcaaaatttatcagctaatcttcgttttttgcggttgcgggactgggctagctggattcgaaccaacgatcacggagtcaaagtccattgccttaccgcttggctatagcccatcggatgtaattacagtatgtgcgtccggcgccgatttatacatacaaaggaatttgaatggaggagacccgtgaaacatttgagtgaaacattatctcgaaccttaattgaagaatcaggtgaaatcacacgccagtggctgctcataccaaaatcggggcggcctacagatgatcagaaagcggaaatgcagcaccgtctgttaattgaaatcgttgccggcattttatcggaaaaagacggcggggaagaggagctgacaaaatgggcgcttcagttcgcaagggaccgggccgtccatgaagtaccggtctatgaaagcgtcacgagctttaaagaattccggagattggtctggaaccgcatacagacgtgctgtgaaacaatgtctgagaagcctggggcgaatgcggtattccattggggagagaagctgaacaaagcaattgaccatatgattgaagtatttacagaggaatattataaagtgacggttacacaattaaacgcccaaaaagaaatgattaacgaactaagtgcgccgattatgccgattgccgacggtattggaattttgccgctcgtcggcgaaattgacacctaccgggcaaaaatgattttggaatcggtgcttgaccaatgttcttcactccgtctttcttatttatttttagatatatcaggtgtgccgattgtggatacgatggtcgcttatcagatttttaaagtgattgacagcacaaaacttcttggcatagaaacgacaatctcaggcatcaggccggaaatcgcgcagaccgtcgtgaagctcggcatcgatttttctcaggtgaaaacggagcagagtctggcgaaagcgctggcaaaaaacggatttatcgtaaaagaatcattaagatgataaaaagctgaatggccgggagggatgtctccctcagctattcagctttgtcagcttcaatcgtaatgatatgatggctgtcgatttcttttaccgtaaatgtgtagcattcaaaatcaatggtgctcccgggcttcgcgtcaatatcctgagtaagaaaccagcccccgagtgtatcgacttgatcagccgtaatctctgttccgagtacatcattgacgtcactgatcagcaatttggcgttcaggagatagcggttcttcccaagcttttgaacggaaggtgtttcgtccgtatcaaattcgtcgcggatttcgccgacgatctcttcaatgatgtcttccgccgttactaatcccgcggttccgccgtactcatcaatgagaatggccatatgggcgtgttcccgctgcattttaacgaataattgataaatcggaatcgtctcaatcacatggatcgccggctggatgtaagggctgagttcgtgttttgtaaacgccgctccttctgacaggaatctgaataaaacttcttttatattgatgatgccgactacatgatctttatctccttttactacgggataccgggtatatttatttgttttgataatgtcccggagcatatgtcccgatccgctgtctaacggcagactcaccatttcattccggggcaccataatttctttggcagtgcgcttatcaaatgtaaaaatattatttacgtaatgcagctcgctttttttaatcatgccgcttcgatagctttcggccaggagcacccgcaattcctcttccgtataagccatttcatgttcggaagcaggcttcaagccgaacatggctgtaatcaggcgggcggaatgattgagcagccagatgaacggaaacattaacttataaaacaaaatcatcggtctggcagacaaaagtgtaatccgctcggctttttggatagcaaaacttttcggggcgagttcgccgataacgacattcacatatgtaaccagcagaaaggcgatgatcaatgacaggacttgggcaaccgcttcgtgaactccggtctttaaaaataacggctgaagcattgctttgactgtcggttcacccagccagccgatccccaaagcggtgacggtgatgcccaattggcacgccgataaatattcatcgaggtgtgtaatgacatgcttggctgcttttgctccttttacattttcctcaatgagctgattaatgcgggagcgccttgctttaacgattgaaaactctatggcgacaaaacacgccgttaataaaataaatagtacgatggcagatagtttgatgatatacaatgtaacgccttccgcgaaggaaggcttgcacctcccttttttcggaataataccactgtagaaagctgctcaaacatcgagcctggtttagcccgcctcatttacggtaataaaacaagaaagcgatactggaggatgacaagagatgaaggtacattcgggagcggactggctgtggtaccagctcggtccgcatgaaaaaacggaagcgaaaaaaatgatccatcacaatcactggccgcaatgcgaaaagtggtttgaacatgaaaatcatataaactttctgcgctcagatacaaatgatcagaataatgaagcggttttcggttctttaatctatcatcaaggattagatgatgaaaaaaaccataccgtatttcacttttatattacgagagacttcttttttacaattaattttgatttttcgctgctgcgcggtgtaaaagaaaagcatgccacacagcagattcaaacctgtgaaaatccgattgaaggcttttttgttctgctgggagagctgatgaattcctatctgatcggactggatgaatttgaagtcaagcagcggacgctgaaatggcagattcatgatgacaacagcaaaggaatcttggaaaatgtgcataaactgcgccatgagctgttcatttggaaaggccttacactgggggctcaaaaagtggaaatggctttaaaagaagcttttctcccgaaaaatgacaggcagaaagattacctcagagctcatcaaaagatggaaagaggaattacatatatcaatgagtttgatcaggaactgagcaatctgctgcacgccgaggaagtcattacctcccaaagaggaaatgaaattgtgaaagccttgacgatctttacaactctctttacaccgatgacggcgcttggagctctctgggggatgaactttgataacatgccggagcttcattggaaatatgcgtatatttgttccatcgtgctcattattgtatcaaccctgctgatttatatttatctgcggcagaaaggctggacaggggacattttgaaggagcatcaaaaaaaatatttgcggaaagaaaagaaacgctaagaagagcaggcatacgcctgctttttttgatggctgaaaatggccgaatggttccggatttcattcggtaaatcaatgtcagggggcttatttttatttttttacgttttacacactgtaaaacgcataatctctcctttgccggcttttgtgtatctgatttacaatacgtgcggaaggagggaagtcttgtgaaaaatatagaaacatacagcaggaacatcataaacgaggcctatacggcaagggcttcagatatacacattgtgccgagagaaagggatgctttcattcattttcgcatcggccatgctcttgtgaaaaaaagagtcttaaaaaaagaggaatgcgtaaggcttatttctcattttaagtttttatcggccatggatataggagaaagacgtaagccgcaaaacgggtcattgtctctgccgcttccgacggaaaccgttcatttgagaatgtcaaccttgccgacaatgaatgatgaaagtcttgtcatcaggcttttgcctaagcggcagattccccctctggataaattgtccttatttcggggggcgggcgccgcattattgtcctttctgaagcattcgcacggcctgcttctgtttaccggccccaccggatctggaaaaacgaccactctttactcgcttgtcaactatgcaaaaaggcatttcaaccggcgtattgtcacgcttgaagaccccgtagaaacaagagatgaggatgtgttgcaagttcaggtgaatgaaaaagccggagtcacatattccgccggtttaaaagcgattttaagacatgatcccgatatgatcatcttaggggaaatcagggatgccgagacggctgaaatcgcagtccgcgcggccatgacgggacacctcgttctttcaagcctgcatacaagagatgctaagggcgccatatacaggctgctggagttcggcgtgaacatgacagaaattgaacaaaccgtcattgccattgccgctcagcgtctggttgatttaacatgtccgttctgcaaagaggaaaactgttccgtgtactgccggatgtacaggcagacacgccgtgcgggcatttatgaactgctctacgggaaaaacctcacccaatgctttcaggaagcaaagggagagcacgccaattttcaatatcagacgctccgcaggctgatcagaaaaggaatcgcgctcggctatgtcacgaccgacaattacgatcggtgggtgtatcatgaagcggattaaacgaacctggccgttgaaggatcaagcggcttttttgaaaaggctcggtgaaatgacggaaaaaggatacagtctgattgaagggctcagactgctgcaactccagctgcataaacgtcagcttgcagagctgacggacggaatccgccggctgagggaaggtgatgcgttttaccaagtgcttgaggcactgtcttttcataaagaagccgtctctatctgctatttcgcggagaaacacggggaattgccgggggcgatgaaacaaagcggcgaattattacagagaaagctcatgcagacgaatcaaatcaaaaaaatgctccggtatccgatgtttttaatatcttccgtctgtgtcatgttttatattctgcaaagtttaattattccgcagtttgctgggatttatcaatcaatgaatatgaatacatccggtacgactgctttcatctttgcgttttttcggcattttcatgaagcctgcgcactggcgctgtccgccgctttctgcttgtttttgtacgtttggttcttatgtaaaaaaaaatccccgcaagataaaatgctgattgttgtgaaaatacccctcttaggaaaagcggccgttctttttaacagctactttttctctttacagctcagcagtcttctgaaatccggcctttctatctatgacagcttaacagcttttaaagaacaatcttttctgcctttttatcgtgaagaagcagagatgctcattacacgtctgaaagccggagaaaccatagaatccgctctttccgggcatccgtgttatgaaaaagaccttgcggctgcagtcagccacggacaggcaaacggcctgcttcaccgcgaactttatacgtacagccagtttatgatggagcgtcttgaacaaaacgcggcgaagtataccggcattctccagcctgtcatttacggtgttgtggccggtatgattttaattgtctacatgtcaatgctgatgccgatgtaccagatgatgaaccaaatgtaagggagtgcttcgtctgaaaaatcaagatggatttactttaattgaaatgctgatcgttttatttatcgtttccattctgcttttaatcaccattcctaacgttacaaaacataatcaaagcattcagcataaaggctgtgaaggactgcagaatatggtgaaagcccaagtgacggcgtacgaaatcgatcatgaaggtaaaatgccggatatgaacgatttacaatcagaggggtatatcaaaaagaatacagcctgcccgaatggtaaacagatcttaattagtggcggagaagttacagttgaacaataacaggcggacagaaaatgggtttacccttcttgaaagcctgattgtgttaagcctggcgtccgtcctgctgacggttttgttcacgacggttccgccggcctacacccaccttgccgtgcggcaaaaaacagaacagctccaaaaagatattcagcttgctcaggaaacggctatcgcagaacataaaagaacaaaaatcacttttcttccaaaagagcataaatataaactgcagtcaggcggaaggattgtcgagcgttcctttgattcgcttcacattacacttgtgactttaccggagagccttgaatttaacgaaaaaggccatccgaattcgggaggaaagattcaattgaagagcgccgggttcacctatgagatcacagtttacttagggagcggaaatgtccatgctaaacggaaataaggggttctctactattgaaacactatcagcaatggccatttggctgttccttatgacgtctatcattccggtctggacgggcatgctgactgatggtctgaaaatagaagatcgccatgaagcgtaccagcttcttcagaaacatatcagcacttatatgatgaccggaaaaaagccgccgtctcccggtgtgaagtggaaggaggatggtgagtattacaaagtgtgtacggctgaccgcagcgaaaaagaaatgtgcctcagcattctcaaaacagactggctttacgcttcttaatgttttgttctccttggcagtctgtcttttcctatcaggcaccttgggcccgattttacatctgtttttatcaaaccggaccgataacggcggattagacagccgggagcatcaaattgccgttcagcagatcatgaacgaatgtaaacaggctgagactgtgaagccggcggacggcggacgggcgttagcatgccggaaaacaggaggcgaagaagtgcgttttgaaatttatcataagatgataaggaaaagagtaaacggaaaaggccacgtgccgatcctgcaaaacgcggcatcattaacggctgatgtgaaaaacggcctgctcttattagagatctcaagcgttgcaggtaaaaagaatcaggcggtcattccggtttacagcttttttaaaggtgattaaatgtacaaatctgacggttttatatatcccgcggttctgtttgtttctgccgcagttttacttgtcatcagctatacttcatctgatttcatcacccgaaaaacatttgcaaaagaggccggggagtactggaccggagagaacctgctccaaaacggcgcgctgctgtcaagccgccatatgacacagggacaaaaggtccaaactggtacacagcgttttccgtatggcaccgtttcttttcacatcacggggagtgatcgccgggaaacggttcaggttacaattcaggcggaaacaacgacaggaacgagacgggaggctcaccttttgttcgatcagaagaagaaacagctgattcaatggacggaagtataaaaaagaggcggcgggacaacacttcatagtaaagacagcactatgaggtgagagccgtgaaaacaaatgattatgtaaaatatatgactgagcaattcgttaaatatttcgatacgccgaaacaggaacggagagagcgaaaagaagtgcggaaagaaaagaaagtgccggcttctcagcactggttcggaatattgccgtatagttttaagctgtggatgcagcggaaaaaataaagtgaatcacacgaaaggccctcctgatacaggagggccttattggtattcctcaatgacggcaattttatttaccttttggctgtagggattaaaagaaatcgtaacaaacacgccaaattcttttgcgccatcccgcaatgtcaagtggtattgcttgactgcttcgtccgttcttttccgatcccacaccttttgaataaataacgtttgggcgagcggatatctttttttagcttccttttctgctaacttttcccattttgatttatggtgaacagcataataaggcaccgtttccgcctgagctgttcctgaaaccccgaaaacaagaagagaaaggcaaatcagactttgtttgatcatcattcttcgtcctttcgctgtatatactttccattttgttctaggcacctcgttattttctcacgttttattagaaaaaattccaaaaaggtgtgtaatttgaagcaaaacgctgtttttaaaagataccattctcaaaaacgaacaatttgaccgattttgacatttttcaagacgataatccttgattatactttgttcatacagttctttaaagagaacggttgtcatatttattaacagttttacagggggtaaggcatgttccgattgttgcgaatggaaaaaaagggcaaggtgagatggcggatgatgctatttttacggctttcgttcattttttgcctgtccgtgacgatatgtgctcagttcacaggtgatacaagttcctccttcaatgatgtaaaaagcttcagtctccaggttcaaacgtgcggagattttcaatatacggatgacgattgccgttatgacgaacgctgggatcaaagtgatttacatataacaaatcaaactgatacgtcaggcaccgtgtgtgcgccgcttcagctctatgccgagctggagaataagggaaaagagcggactgtttctgactggaaatgggagctccataaaatcgcttctcagcagcagcctttacgaaacggcaatgttgtggaaaaagggcttattactgataaaaaaagcaaaacgatttataaaattaagtcaaagcggtctttgcagccgggcatatacgcattcaaggtttacaagcctgaagggtatccggcggacgaagaaaaatttgagtggtcaaaaccgatgaaactcgtcaaatgccgggaacaggcgaccgtttccgatctaaagaaaacggagaaagagccggctgagccggtaaaagaaagcggggaagaacatgaaaaaaacgctgaaactgatcagtaatattttgtatgccgtcatcttcagcttgattattgtgctgacgttaacggtgatttcgacccgggcttccgggggtgagccggccatcttcggctatacgctgaaatccgtgctgtcgggttcaatggacccggaatttaagacgggttcgctcatagcggtaaagaaaatttctgacgtgaatgacttagaaaaaggggatgtgatcacctttacgcaagatgacggaacagccgtcacacacagaataatcggtatcacaaaaaaggacgggaacctgctgtttgagacaaaaggggaccataatgccgccccggatgccgcacccgttcaagctgaaaaagtggcggcccagtatacgggatatcagcttccgtatgccggatatgtcatccatttggccagccagccgatcggaacggcgattctgttaatcgttcccggcgtcatgcttttgatttactcaataacagtcatcgtcagcgccctccgcgatattgagcggaaaacgaaagcgctggaagaacatgcgaaaaagtgaaccatctctacatgaatacggttgcaacctggcgacaggatttgataacaaaaataaaaagtaaggggagagtacagacatgggtatgaaaaagaaattaagcttgggcgttgcctcagccgcactcggtttagcattagtaggaggaggcacatgggccgcatttaatgatgtgaagtcgacagacgctacatttgcgtcaggaacacttgatttatcggctaaagaacaatcagccaatgtcaatttgtcaaacttaaaaccaggtgataaattgacgaaagattttgaattcagaaacaacggttcacttgccattaaagaagtgctgatggctttgaattttactgactttaaaggagcaaagaaaggaaatgaatctgcggaggatttcctcagtcagtttgaaattacggttctgacagtcggtaaagaagggggcaacggctatcctaaaaatatcattttgaaggcggccagcctgaaagacttatacttaatgtcaacaaaacaggataaagcagctgccgaagcgatcagcaagcacattgatccgaaattcctgagtgagagcggaaaagtcaatgtagcaaccattaacggcaaaacagctcctgagtacgacggagttccgaaaacgcctgctgattatgaccaggtgagaatggaaatccaatttaaaaatgacaccgcaaaaactgcggacggattaagtgtgcaaaacaagttccaaggcaatgcgatttctcttcaattctcttttgaagcaacgcaatggaacggcttgaccattacgaaagatcatacggataaagacggttacgtcaaggaaaatgaaaaggctcacagtgaggataaaaactaatccgaaagtcggacagttaaaagaggagttgtgcacatatggcggcactactcctctttttgcgcttttctccatttttgataatctaaaaattcacgaaattgtttttttgataccccggatgtcatcgcatcgcgaactaatttctcccattcactatctaattgaccatcgtattcggtttcatgtttttcatcaagtaaagtatgaaccgagacgtccagaacagcggagactttttcgagaaattgaatggaggggttcgtctgtaaatttcgttctattgagcttaaataagacttcgctaccccagctttttcagctagttctgatagtgagtagcctttttcttttcggtattgtttaatacgctggccaatcaatgtcatcaccttccttgtgatattatagcacattcagaaaggatttacggtatgacttctggctgcctggatatgttgagaagactttttatgcgaaagcaggtatttgcgtatttcttctaggctgatatttgctttttgggcttctaatatcagctcaacccattccttatctaattgcgaaaattccatttttgcatttttcatgcattttctcctcctaaaatacttgtttatgtatttcagccaatccgcccatgaccttatctttacatgtctggaagtgattcatcgcatgcgaaacgccagaaattttttctatatacttttattataatatagaatttccagaaaaaacgggaaaggtgtcgaatggataacgcttatccagaaaaattactttgcaggaaaaataaaccgccgttttcaatctgaatgtgaattttcggctgatataaggctttcagcgcttgtttttccaaatggtattcctcaggtttttcctctgtctgctcataaaactgatcgagcagcctgaggtcctttttccatctggcgatcgcgctgtcagcccaggctgacggctctttggcggcagcgtcttttaagtaatgctccattcttttaattccgctttccggcttaatcatcggcgatatggtaaagcaatagtctgatatttgcgaggtcagcggaagcggtgcaagcttctgctgaaacccctctataattgttccagaaacaagatgcaggcctaaagacaaaagtctgtcttttttcatgtcggattggtatgaaatcactacatttaatccaagccagggctgaagcggcactctggctccggctgatacaattttctcatatattcttgtaaatctcccattttgtttaactgcttgaaagatttgaaagaggcgcggggctccaaagtaaataaattcgccgtccatatcctccggagccgtttctttatcagtgatgaacgtgatcttcatcgggttcggttcgccgcccgttttttcacgccaatgccaataaaacgggcggttcataatttgtttgtccatctcgaccgtcaactgaaccgtcataaaacccggcccgtgttctgtaatcggacagtggttcgcttcaaaaaagcgcagtaaaaattcgtgaacctcctgctgtctcatgtcgcgcttcctccttttagattaagatcctttttttctggcgggcttttccgtaccgtacgacagaaaagaggtgagattgtccattttgattctcatttcttcctctgtcagcgaatggcataaaatatcatgcaaatggtcttcaaaattgctcactttgatttttgttaaaatgtcatctaattctccgacgacattttcaaataaatgaattttgtcatacagaagttttaaaatatgctcttccaccgtatgttttgtcgccatattgtagatatggacatctctttcctgaccgagtctgtgaatccttccgattctttgttcaagccgcatcgggttccacgggaggtcataattgataatatggttgcagaattgcaggttgatcccttcgcctccggcttctgtagcgatcagcacctgcactttgccgcggaagagatccttcatccagtcttttttcccgcgtttaaatccgcctctgaacggaacggagcttatgccgttctgctgaaggaaccattgcagataaatctgtgtcgccctgtattcagtaaaaataatgactttatcattaatcttttggatcaagtcaacaacttgaattgcttttgagttttgcgtgacttgattgatgcggtccattaaattagcgatcgtctgatcatcgaatgcgggcgcttgtttgtctttttggtcaagcatttttttgagcgtcatatacacggcttccctgcttgaacagcattctctttgcagcgtcataatggaaaatgcgcttgcgggcttttccgtgccgtttttcagtgcggcgatgtcatcgtaaagcgcctgttccgtcggtgaaaaggtgatcggcactgtttccacgtggcgcttcgtccatgtaaggccggtgtcgctccgcgtgttgcggatcatcaccttattgacgagttctttcaaatgctcatgagcgtcaatcccgtccttctgattgaaggtttcttgaaatccgctttcgtttcctaaatggccgggctttaacagtgacactaaattgaagatttcttcgatccggttttgaatcggcgtcgccgtcagaagcaggcagtatttcttcacaagacttctcgcaaattcataatttttcgttttgctgtttttgagcttgtgcgcctcgtcaataatgacgagatcatacggaatagaaaggacaatgtctttgtgaggcgagcgtttggccgtatcaatagaagaaacgacgatatcgcactgttcccacacatagcttttcttctgttcaacagcgggtattaaaaacttctcctgaagctctttcacccactgggaaacgagtgatgccggcacaagaatcaggatttttttggccagcccgcgaatcatatattcttttaaaatcaggcccgcttccaccgtttttccgagccccacttcatcagccaaaatcgccttgccgttcattttttcaacgactttctgcgcgacctcaagctgatggggaagcggagtgaaatcgggcaggtataaaggagccctcaacccttcaaattcaggaatggcaagggtctgctggacttcagccgacagtttgtacatctcccaatttgaccagggaccgtccgttttcagccgctcagaaaactctcccggccagtttgcatcaaatatgatctctgctgtcatatgtaacaaaaccgcctttcttttaaaaaactgatttatcataatttttgttgccggacgtaaatgagggtggtaggatataagtaatgatttcactaaaagatattgctttagtatgtccataaaattggtaaatatgagcgaatgacagcaaggggagagactcggacgaaagatgggcgtccgggcgccgaaggagcaaactgcggagtgaatctctcaggcaaaagaactcttgctcgacgcaactctggagagtgtctgcacttagaagcagcagaccaccaaaggggacgtctttatgatatgttcataaagtaaactttcaggtgccgggacagagaaaccttcattttcatgaggtgtttctctgtccttttttatatgtttttacaatgcgccaatgactgaagggggaagatgatgctgaaacgaacaccgctttatgacgtgtataaagaatacggcggaaaaacgattgattttggaggatgggagctgccggttcaattttcttctattaaagaggagcatgaagccgtccgcacaaaagcgggcctgtttgatgtgtctcatatgggggaagtcgaagtatccggtaaagacgccctgtcttttctgcaaaaaatgatgacaaatgacgttgccgatttaaagccgggaaacgcgctttataccgccatgtgttatcctgacggcggtacggtcgatgacttgctgatctatcagaaaagcgagagctgctatctgctcgtgattaacgcgtctaatattgaaaaagacatcgcctggctgacggaacatgcggaaggcgatgtcacgctgacgaatcagtctgacgggatttcactgcttgctgttcaggggccgaatgctcagtcggttcttacgaagctgactgaatgtgatttgtcctccttaaagccgtttacatttattgatggggcggacgttgccggacgacaagtcctgctttcaagaacaggctataccggtgaagacggatttgagttatattgccgcaatgaagatgcggttcatctatttaaggagatacttgcagcgggagagcatgaaggcctcgttccgtgcggcctcggcgcccgtgatacgctgagatttgaagcgaagcttgctttatacggtcaggaattgacgaaagatattacaccgattgaagccggaatcggatttgccgtgaaacacaagaaagattccgattttttcgggaagtctgtattgcgcgaacaaaaagaaaaaggagccccgcgaaagctggtcggacttgagatgattgaaaaagggattccgagacacgggtacgccgtgaaaaaagacggtgttccgatcggtgaaatcacgacaggcacgcaatctccgactttaaagaaaaatatcggccttgccttaatcaaaacggaattcagtgaagtcggaacggaagtagaagtggaaatccgtaaaaaaacggtaaaagcgaagattgtccgcacaccgttttataaacgtccaaaacagagctgaaaaaggagagtcatatgaagcatcgatatttgcccgcgacagaacaggataaaaaagaaatgctgaaagccatcggcgcagaaacaattgatgaactgtttgccgatattccggaaaatgtacggtttcaaaaagactaccaaattaaaaaagcaaaatcagaaacagagctgacgagagagctgacgaagcttgcggcgaaaaataaagacgctgttacatatgcatcttttctgggtgcaggagtgtacgatcactaccagccggttatcgtcgatcatgtgatatcccgatcagagttttacacggcatatacgccttaccagcctgaaatctcacaaggagagctgcaggcgatttttgaatttcaaacgatgatctgtgaattaacgggaatggatatcgcaaactcctctatgtacgacgggggaacggcgctggcggaagcggcgatgcttgcgtcgggacatacgaaaaagaaaaaaatcgtcatttccgcagccgttcatccggaatcgcgggatgttttgaaaacatacgcaaagggccaatatattgaggttgtagaggtgcccgcgaaaaacggcgtcacagatcttgaagcattggaacatgccgtttgtgatgaaacggccgccgtgatcgtccagtatccgaacttctttggacaaatcgagccgttaaaggacattgagccgctcgcacataaaggaaacagccagctgattgtttcttcaaacccgctcgcgctcggtattttgagaccgcccggggcatacggagctgatatcgtcgtcggggacgcgcagcctttcggcatacctgcggcgttcggcggcccgcactgcggctattttgcagtaacgaaaaaactgatgagaaaggtgccgggccggcttgtcggccaaacggaggatgaaaacgggcgaagaggttttgttctcactcttcaggcgcgcgagcagcatatcagaagagacaaagccacgtctaacatttgttcaaatcaggcgctgaatgctttagcggcttcagccgcgatgacggcgctcggaaaaaacggcgtcaaagacatggcccgccaaaatatattgaaagctgattacgcgagacgccaagcggaaaaagccggcttgcacgtagcatttgacggcccgatatttaatgaatttgccgtcaggctgaatcttcccgtcaaggaagcaaaccggcggctcctgcaagacggcataatcggcggatatgacttaggccttgcgtatccggaactgaatcagcatatgctcattgccgtcacagagctgagaacaaaagaagagatcgattcgcttattgcgggattgggggatcaacatgaataatcaagatcaggcgcttatttttgaaatgtcccgcgaagggcgtatcggttacagccttccggagcttgatgtgccggaaaaagagcttgaaagccttcttcccggtgactatatccgcgatgaagacgcaaagctgccggaagtatccgagctcgatattatgcggcattataccgctctttctaagaggaaccacggagttgattcaggcttttatccgctcggctcctgtacgatgaaatacaatccgaaattaaatgaaaaaattgcccggatcgcaggtttttccgccattcatccgcttcaggacgagggcacggttcagggggcgcttgagcttttatacgatttaagcgggcacttggaggagattacgggcatggacgaggtgacgctgcagcctgcggcgggcgctcacggcgaatggaccggcctgatgatgatccgcgcctaccacgaagcacggggagacttcggacggacgaaggtgattgtccctgattcagcccacggtacgaatccggcatccgccacggtcgccggttttgaaacgattaccgttaagtcaaatgagcacggactggttgacattgaagatttgaaaagagcggtaaacgaagaaacagcggcgctgatgctgacgaatccgaacaccctcgggttatttgaggaaaacattacggaaatggctgaaatcgtccatcaggccggcggaaagctttattatgacggagcgaatttaaatgccgttttaagtaaagcaagaccgggagatatgggatttgacgtcgttcaccttaatctgcataaaacatttaccgggccgcacggcgggggaggaccgggttcaggtccggtcggagtgaaaaaagaattcattccgtatctgccgaaacccgttctcacgaaaaaagaggggcgtttgacttttgactatgaccggccgcagtcgatcgggcgtgtaaaaccttattacggcaacttcggcattaatgtcagagcctacacgtatatccgttccatggggcctgacggcttaaaagctgtgaccgaaaacgcggttttaaatgcaaattatatgatgagaagactcgcgccttattatgatctcccgtatgaccgtcattgcaagcatgaatttgtgttatcgggaagaaggcagaaaaagctcggcgtacgaacgcttgatattgccaaacggcttttagacttcggctatcatccgccgactgtgtattttcccctcaatgttgaagaaagcatcatgatcgaaccgacggaaacggaatcaaaggaaacgctagatgcgtttatagatgccatgattcaaattgcgcgggaagcggaggaatcgcctgaaatcgttcaggaggcgccgcatacaacagttgtcaaaagaatggatgaaaccaaggcggcaagaaagcccgttttaaaatacgaacgtacacttgacggcagccgctgacacggtgtaaaaaaaaagagctgtccgttttatacggaagctcttttttatgattagttttttgctttaatttttccgccccattttttaaatccgcctttcaggttgtaaatatctttacagccgtgtttgcggagcgtctgtgccgcgcgtccgctgcggacattgttttggcagtacagataaacgggtttatcaggacggatttcacttttgcgctgtttcagctgtgacagcggaatgttgcgcgcgccgagaatatggccgccttcaaattcattcggttcacggacgtcaatcagctgcgcttttctgtagcccgcgcggaattcctcttccgtaagtgttttcattaaacgctgctggtaaaaatacgacacgatcatataaacgataaacgcagcaacaataattaaagcaatcatattagacaatgcgattctactcctttaacttataaaatcaaaaccctgcttcctgaaaacaaggcttaccggacgttttgggacaaatactattatagtaaagcatgaagcgattgtcatccttaatgaaacgaaatatttttcattttcaaggcagtttgttaaactgattttattaaaacgataaagaagggttcagtgtatggaaaaagaaacatggcggtttattgactcagggaatgaaagcccggcatttaacatggcgctggatgaagcgcttttatattggcacagccaaaaaaaaattccaccggtgatccgtttttacggctggaatccggcaactttgtctgtcgggtattttcaaaatattaagaaggaaattaactttgatgcagtacataaacacggcctcgggtttgtcagaagaccgacaggcggacggggtgttctgcatgataaagaattgacatacagcgtaatcgtttcagaggatcacccggaaatgccggccacggtgacagaggcgtaccgggtgatttcagaaggtattctgcagggattcagaaaccttggacttgatgcctgctttgcgattccgcgaacggagaaagaaaaagaaagcttgaaaaatccgcgctcgtccgtctgctttgatgcgccttcgtggtatgaactggtcgtcgaaggacggaaagttgccggaagcgcacagacacgccaaaaaggcgtcattcttcagcacggttccatcctgcttgacattgatgaggataagctgtttgatctgtttttatatccgagcgacagagtccgtgaacgcatgcagcggaatttcaaaaacaaagcggtagccatcaacgccttagcgccgaaacgggtaacgatggatgaggccagaatcgcttttaaagccggttttgaggaagggctgaacatacatcttgagccctacacactcacgtctgaagagcttgcatttgtcaatgagctggctgagacgaaatacgcgtccgatgaatggaattataagcgctgataaggcttgacagaccggaagcatccttgttttttcatgaccgttagtgtaaacttgtaatggtttataaagttaaggtgctttttgggagggttacttatgacaacaccaagtatggaagattatattgaacagatttatatgctgatagaagaaaaaggatatgcacgggtttctgatatcgcggaagctttggcagtccacccctcctctgtaacgaaaatggttcaaaaactagataaagacgagtatttgatttatgaaaaatatcgcgggctcgtattgacgtcaaaaggcaaaaagatcggcaaacggctcgtatacagacacgaattgcttgagcagtttttaagaatcattggtgttgatgaagagaagatttacaatgatgttgaaggaatcgaacatcatctgagctggaacagcattgaccgcatcggcgacctcgttcagtattttgaagatgacgaaagccggaaaaaagaattgaaatccgtacagaaaaaaaccgaaaatcccggtgaataaagggcagcccgaaatggggcgccctttttttaatgtcttcattctttggtctatttcgcccagccgtttcttaaaataataatacaccttgagatggaagggagagggcgcgctatgcagattgacggcgtattttcgggcggggggataaaaggggtggcgcttgccggcgcttatgaagcgctggaagaaaagggctttcgctttgaaaggctcgccggaacaagcgccggcgcaattattgccgcatttatcgctgcgggctatacgagcagagaggttcattccatcatagatgaggtggacggaaggcaattgcttgatcagagatactcattcctcccgctgaaaatcctgcggtgggtgtcgatatattggcgcctcggactatacagaggcgatatgctggaaaaatggattgcggataaattaaaagcgaagggcatcatcgcgttcggcgatttgaaaaaaggctcgctccgtctcatcgcttcagatctgacgaacggaacgatgatcgtgcttcctgacgatcttccccgctacggattaaatccggagatgttcccggttgccagagccgtcagaatgagctgcagcattccttatttttttgaaccgataaaactgaagacagaaaaaggcagctcaacggttgttgacggcggcgtgttaagcaatttcccgatttggctgtattcaaaagaacgcaaacggccggtcatcggaatttcgctttcgccaaacgaaaaagagcgcccgaaaaaatcaatccgcaacgcttttgagctgttcggggctttgtttgaaacgatgaaagacgctcatgatgccaggcatatcgcgacaaagtacgaacagaatattatttttattccggtggaacatgtgatggcgacggagttttatctcacaccgcaaaaaaaactagctctcattgagctaggaaaaagcagaacagagcaatttttgaagcaatggagctattaaaaaagcgctctgtttttctttttattctttttgccttctatgacggtaagctgggtctggctttttttcttaagaatcatcggcttcggtctgctgctgctcggcacgctccgcaaatggctgacccggcctctgtgtccggcgcggtgcttcgctttttgctccttcattcggagccgcgattgtctggccgcttttctgaaagcggttccgtcacggccggtgcggcggttcaggaccgtcctcacgataaaataaattatgatgcctgcgataataacggtgatcgctcttgaaatcatctgcccggggttggttaccgccgcataaatgaaaccgaatgcgccaagcgctatcaatacagcaaaaaaaggttgtacacgatgattcataactgcccacctccaaaataataacggtaacggttcagattacgttgtgagacggtttttcgctctgttctgaaatgtcttccagtctgagaagctcgttaaagctttctatggcaacctcgacctggtcatccgccggttcctttgtcgttaaaagctgcagccacaggccgggataaccgagcactttcaaaacggggatattccgcactctgttcgtcagctggagcacttcaaaggagatgccgagaacgaccggtataagcgcaatcctgtctaaaatccgcacccaaagcggatctgtcggaacgagtaaatagatgaacatgccgacaatgatcgtaaataaaataaagcttgaaccgcaacggtaatgaagccgtgactgtttctgaacattttctattgtaattggcaaattctgttcataacagtttatgaccttatgttcggctccatgatattgaaacactcttttaattaacggcgtcattgataaaaaataaatgtagccgagaagcagaataagcttaaacagactttcgattccgatctgcgcggcgtctgaggaaaatacgggccttacaagctccgctaagaagaccgggacgagcgtaaaaacgaatttgctgaacaaaaacgacagaacgccgatcaccgccaggctgaaaaacatcgataagcccgaacctttcttatcttcctgctccagctttgcgtcatcttgaggatcaagcccgtaacgttcgctggaaaagtttaaatgctttgtgccgttggcgctcgcctcaatgatggcgacgattccccgcaaaaaaggaatcttttttaaagccgaaagcttggcgttcggcactctcggaagcttgaaaaaatcaatgcttccgtcattcctgcggatggcggtaacataattttttctgccgccgaacatgaccccttcaacgacagcctgcccgccgtaagcagggggcgttttttgtttggacattgtttatcaacctgcctgtttttttaggatttactaaccatttcctttcactctattgtacaggaaaccgcggtaaacctctagttagacagccggaaaatcaatgctttttctacatgcagtataccccgtttctttagattttactcattgaatgaaaatatggcgcagctttttatgacttttcaattttggggcagtctatgactggaggtgccatgatgacaagcgaaaaacattcagaacaggaagaaaaaaagaagcaggatgatgatcagcagcctgtttcatttaccggcagaatttgcggtatcggatttgccggcggtgtattttggagtttgatcggctatctcgggtatgtctttcatttttcagagatcagccccaacatgattcttcagccgtttatgatcggagaatggaaaaaacaatggctcggcacgatggtcagcatcgttgtcatcggattcatttcaattgccggggcgtttatttatttcgtctgcctgaaacgttttaaaaccatgtggccggggatggtgtacggcgtcattttatggtgtgcggtttttttcttattcaatccgattttcgaagatgtgaaatccgtcactgaattgaaatcagatacaatcgtgacgacgctttgcctttacattctgtacggtttgtttgtcggctactcaatttccttcaactacaatgaacttacgtcagacaagcttgcaagggcgcttggcaacaagtgaataagtgtataatccctgtccggtatggtaaaatgttcacgagaagtgaacattttttatgctgaaaaccgggcggggatgctcccgcgttgtcaggcggcagtcaagaatcggcgaggaggagaaagggaatgaaacttgagaaattgcgaaatcttttcggtcagctggatatagacggaatgttggtgacaagctccgccaatctgcagtatatgacgggatttacgggttcgtcaggccttgcggtcatatcgaaagaacgtgcggcatttatcacggatttccgttacaccgagcaggcgaagacgcaagtgaagggttttgacattatcgagcacggcggaagcttaatccaaacggctgcggatacgattcttgagtacggcattaaaaaactcggcttcgagcaaaacagcatgacgtacggaacatatgcatcctaccaagcggtgctgcaggaagcggagatggttcccgtcgcggattccgttgaaaagttgcgcttgattaagtcaagtgaagagattaagatattagaggaagctgcgaagattgcggatgatgcgtttgaacatattctgacgtttatcaaaccgggcatctcagagatttcagttgcaaacgagcttgaattttatatgagacgtcaaggagcagacggctcttcctttgatatgatcgtcgcctcgggagtcagatccagccttccccacggagtggcaagcggcaaattgattgaaaagggagacttggtcacgctcgatttcggcgcttattataaaggctattgttctgatatcacacgcaccgtcgcggtcggagagccaagtgataaactgaaagagatttatcaggtcgtatacgatgcccaagcgcttggtgtcctgcatattaaacccggcatgacgggaaaagaagcggacgccctgacgagggatcacatcactgcaaaaggctacggacagtatttcggccattcgacaggacacgggttcggaatggaagtccatgaatcaccggggctgtctttcaggtcatcggccgttcttgagccgggcatggcggtaacggttgagccgggcatatacataccggaagttgggggcgcaagaatcgaagatgatatcatcatcactgacgacggcaaccggacaattacgcattcccctaaagaattaattattttgtgatcggaatataggaggacatcaaacatgatttcagttaacgattttcgtacaggactaacgattgaagtagacggcggcatttggcgcgtcgttgacttccagcacgtaaagccgggaaaaggagcggcatttgtccgttctaaattgcgtaacctccgcacgggcgctattcaggagaaaacattccgtgcaggtgaaaaagtcgcgaaagctcaaatcgaaacaaaaacgatgcagtatctttatgccaacggcgatcagcacgtgttcatggatacaagctcatatgaacagcttgaattgaacgaaaaccaaatcgaagaagaattgaaatatcttctggaaaatatgtctgtgcacatcatgatgtatcagtctgaaacgctcggtattgaactgccgaacacagttgaactgaaagttgttgaaacagagccgggaattaaaggcgacacggcgtcaggcggcacaaaacctgccaaaacggaaacaggccttgtcgtaaacgtaccgtttttcgtgaacgaaggcgatacgctggttgtaaatacatcagacggctcttacgtgtcaagagcgtagtcaaagaaattcggagtctgctccttttacggggcaggctttttttgcgttctgcctgaatctttcttctatatgaaaatagtgagactacttccgtcagctagagcatatagtgtaacaaaatgcttgaagttgggggattgcaatgaaatttttgtttggttcaatcaattctactgttttaacgatggccggtttacgagttttgtcctcgctcattgaattatcggccgctattatcatgcttttgacaaacgacatcagaaaggcggttgtggtgaatagtattttggcaatcgtcggcccgctgatctttatcatcacaatgacgatcggcatttatcagattgccggacagctctcatatgcaaaattaatattgatttttgcgggagtggtgctgattttggccggtgtgcataaatagagggccggggtgtcataaagtctgtcccggatcatacattttaaagaagccaatcggtaaaaaaggaggagactctattgaatgagattacagaggttctccctgaattattgagagatgccatctccgctgtgcccgaagaagcgagacgggatacagaagaaatcagaatccgcgtcgacaggccggttgaactgatccaaaaaggacaacctttgtatttgtcatatgtctgtacggccggcgacgcacagctgatcctcagccggctcagcaattacagtatgtacacgctggaagaagagctgaaaaaaggatatatcacaatcagaggaggccaccgtgtggggctggccggaagagtcatcgtcgaaaacggagccgtcaaaggactccgggatattacttcttttaatatccgaatcgcccgggagaagctgggaatcgcagaaccgctcattcctttcttatggaaagaaaactggctgaatacgctgatcatcggtcctccgcaaacggggaaaacgaccttgcttcgtgatttggcccggctttccagcaccggatcaaaacgcattcccgcaaaaaagacaggtatcgtagatgaacgttcggaaattgccggctgcctgcggggcattccccagcacagtttcggccgcagaatcgatgtccttgatgcctgtccgaaggcggaagggctgatgatgatgattcgctctatgagtcctgatgtcataattgtggatgaaatcgggagaatggaagactcacaagcgctgctggaggcgctccatgcgggcgtatccgttatcgtatctgcgcacgggtggaatatgaaagacttggtaaagaggccgtcgctgaaaatgctttgggaggaaaacgtgtttgaccggtatgttgaactgtcaaggcgccgcggtccgggaacgatcagcaggatgtacggaaaggacggggaacctgttccgcatgctgaaagcgtgatgacatgctgaagcttttgggtgccgtgtttattctgacagcgacgacttggaccggatttgagatcgccaaaatgtatatagaaaggccgaggcagatccgtcagctgcgcgcggcgctccaatcgcttgaagcggaaatcatgttcgggcatacaccgctgcataccgcctcgggacaaattgccgcacagctttccaaacctgtatcgttattgtttcaagctttcagcagaaggcttgagcagggaagcgattccgccaaaacggcttgggaacagagcttgaaacataattggtcgtccatggcgatgaaaaaaagcgaatatgatgtgctgaagcaattcggagagacgctcgggctccatgaccgtgtttctcagcagaaacatatcaagcttgcgcttacacatttggaagcggcggaagcggatgccggacgggcgcaggcgaaaaatgaaaaaatggtgaaaagcttaggatttttagccggactgttactcattcttctattgatgtaaacatgaggggagcaaacataaaatgggagtcgacgtaaatgtcatttttcaaatcgccggagtcggtatcgtggttgcgtttctgcacaccatacttgatcaaatgggaaaaaaagaatacgcccagtgggtgacgctgcttggctttatctatattttatttatggtggcgacgattgtcgatgacctgttcaaaaagatcaaagctgtgtttctattccaaggataggggggcttacagattgagattgttcaaattgtaggtttaggcctgatcgccacatttctctccctgatcgtaaaagaacagaaaccgactttcgcgtttatgattgtcgtcttcagcggctgcgtgatctttctttatctcatcgaccagatttacgacattatcagaatgatagaaaaaatagccgtcaatgcaaatgtcaatatggtctatgtggaaaccattttaaaaattatcggcatcgcctacatcgctgaattcggagcgcagcttacaaaggatgcgggccagggagcgattgcttcgaaaatagagctggccggaaaaattttgatactggtaatggccgtgccgatactcaccgtcattattgaaacgattctcggacttattccttcttgattataaataaaatggaaaggggggggcacaaaaaatgaagcgctttcggtgggcgggagcttttttgttcatcctcttattttttcagactgaatgtgtacaagctgccggaacagacggtgcgtcgcaggaaaccgcagttcaccaagaatccgctgatgaagtggcgaaaaagcaggccgaagcgctgaaaacagaaggcatcggaaagttttgggacgacatcatgacagaatacggcggtcttctgcctgaaagccaaaagggaagcatcgtcgactttattaacggagaaaaaacgttctcgccggaggcatggctgaaggctttattttcatacgtgtttcatgaagtgctcgcaaacggaaagcttctgggaactttgattcttctcaccattttttgtgtcattctgcagctcctgcaaaatgcgttccagcagagcaccgtcagcaaagtggcttatgcaatcgtctacatggtgctgattattctcgctttaaacagctttcatgttgccgttaattatgccagtgaagcgatccagacgatgacaagcttcattctcgcgctcatcccgcttttacttgcgcttttggcgtcttccgggggagccgtttccgcagctttttttcaccccgttattttatttctgatgaatacgagcggccttctcattcaaaacatcgtcatgccgcttatcttcctgtcagcgattttaagcatcgtcagcacgatgacggatcaatataaagtcacgcagcttgccaatctgctcagaaatatcgcgatcggcgcgcttgccgtatttctcaccgtgtttctcggcgtcatctccgtacagggggcttcggctgccgtgacggacgggattactctcaggactgcaaaatttataacaggcaattttattcccgtgctcggccggatgtttacggatgcgacggatacggtcatcagcgcctcgctcctattaaaaaacaccgtgggaatcctcggagtcggaattttgatctgcatctccgcgtttccggcgatcaaagtgctctcgctcgcttttatttataagctcgcggccgctattctgcagccgctcggaggcgggcccgtcattacgtgcctcggcgtcatcagcagaagcgtactgtatattttcgcggcgctcgccatcgtctctctcatgtttttcctcagcatcacagtcattattacagcaggcaacctcaccatgatgatgaaataaaggaggcccattggatatgagctttttaacagaatggctgacaagcattattttatttatcttattcgccatcgtcatcgacatgctgctgcccagctccagtatgcaaaaatacgcaaagatggttgtcagtctgctgttaatcattgtcatgctcaacccgatattcaaacttttcaaaacagacccggaaatcatcttcgattatttgacaaaacaagagcaatctcaatccgctgatataaaaaatcaaattaaatcagaaaaaaaagaaatacaagcatcaaaccgcgcatatgttttagaagaaatggctgtccaactaaaaaagaaagcggaggagatgttcagtcatgacgaatacaaaatagacgacatccgccttacagcggaagaacaggttcgttcagaagaagatgtaaaaacgatcagcgtgtatatggccccatcttctgaaaaaaccgtgcaaaccgtcgcaccgatcgacatccgcacagaccgcaaatacgaaccggaaggcgcagccgacaaaaaagaggccgcagacatcaaagaaaaacttgcggatatatgggaaatcggcagtgagaaaattacggtttatatggaaggcggggagaaaaacggccatgaataaaaacggactatggaccatactcaaaaaacagctgatgatcggacaggcgaaagacggagaaaaaccaaaactgacaaaatatcattactttctgttcgtgtttgtgctcggggtatcttttatgctggtgagccagctgttctcttcaccggagaataccgggaaggaccaagcggtgcagaccgtcatgtccggccgaacggaagacaaaagcgggcaaaaaagcgcacccgtttttaaggcatcgaaagacggcagcgcaaaaaccacgatcgatgattacgaaagagactatgaaaaccagctgaaagaaatccttgaaacgattatcggcgtggaggatgtctcaattgtcgtaaacgtagacgcaacatctttgaaagtgtttgagaaaaataaaacgaaaaaagacaccaccactgaagaaaccgataaagaaggcggcaaaagaagcgtaaccgatcaaacctctgaagaacaaattgtcatgattcgaaacggggaccaggaaaccccggtcgtcgtccagacgaaaaagcccgatatccgcggtgtactcgttgtcgctcagggagtggacaacgttcaaataaaaaaaaccatcattgatgccgtcacaagggtgctcgatgttccgagctatcgtgtagcggttgcccctaaaaaaatcaaggaggattcataaatcatgctgaaaaaacaaacggtttggcttttaacaatgctcagtctcgtcgtggtattaagtgtttattatattatgtcgccggaaagcaaaaatgccgtgcagatgaaaagcgaaaaaagcagcggagaagtcgccactgaaaaaacgccggctcctgaaacgaaagataagagcggaagcggcacggaaaaagaagacggcacaaaaggaacgaaagattctaaaggcacaaaagaggataaagaaacatcagccgaagcttcggacaaagacggatcggtcgccacagaaacagctgatgaaaacttatttaccgcataccgcatggagcttgaagacgcgagaagcaaagaaagggaacagttaaacagcattgtttcaagcgatgatgcgaccgcaaaggaaaaaagcgaagcctacgataaaatgacggcgctgagcaatgctgaagggacggaaaaacagctggaaacgctgattaaaacacaaggctacaaagatgcgctcgtggatgctgaaggagacaaaatcaacattaccgtcatgtctgacaaacattcaaacgcaaaagcttccgctatcattgacctggtggaaaaagaaatcaagacgatgaaagacgtcgccgtcacgtttgaaccgacaaaataagagacctgaaccgcccgcacccgctgcgggcttttctgatgtcattttagatcagtgttgaatttacacaagcgctcctgtaagataaacatagtatgtacttttagtagcaacccataaatttctattttttatacataggagtggaaactgatgttaaaaatcaacgaaattcatgaactgataaaaagaatcgatgaatcttccatcgacgaatttgtttacgaaattgaaggcgtaagcctcaaactgaaaaaaaatgaagcgccggcagtgaatgtaacgggacaagcccaagccgttcccgccgcttacgcacctgctccgcaggctgcaaaaccggaagcgagtgaagccgctcctgctcaggaagcgccgaaacaagacgaaaacctgcacaaaattacgtctccgatggtcggaacgttttatgcttcttcatcgccggaagccggcccttacgtaaaccaaggttcaaaagtgagcgaaaatacagttgtttgtatcgtagaagcaatgaaactctttaacgagattgaagccgaagtaaaaggagaaatcgttgaagtgttagttgaaaacggccagctggtcgaatacggacaacctctatttcttgtaaaagctgagtaaggagacctgctattatgattaaaaagctattgatcgccaaccgaggagaaatcgccgtcagaatcatccgggcctgcaaagagctgggcattgaaactgtagccgtttattctgaggcagataaagacgccctgcatgtccaaatggccgatgaggctttttgtatcgggccgaaaacatcaaaagaaagctatttaaatgtaacgaacatcgtcagcgtcgcaaagctgaccggcacggatgcgattcatccgggatacgggtttttagctgaaaacgccgactttgccgagctgtgcgaagaattaaacgtaacgtttgtcggccctacggctgacgccatttcaaaaatgggaacaaaagatatcgcccgcgacacgatgcagctggcgggcgtgccgattgtgcccggttcaaaaggaatcataaaaaatacggaagaagcggtttcgcttgcaggtgaaattgggtatcctgtcattataaaagccactgcgggcggaggcggaaaaggcatccgggtcgcacgcacagaagaagaattgatcaaaggcattgagattacccagcaggaagccgctacggcattcggaaatccgggtgtgtacatcgagaagtacatagaagatttccgccatgttgaaattcaggtgcttgcggataattacggaaacacgatccatctcggagagcgtgactgttctatccaaagacgtctgcaaaaacttcttgaagagtcaccgtcacctgcgcttgattctgaaatcagggagcagatgggtgaagcagcggtaaaagcagcgaaggccgtcggttacacgggagccggcacagtagaattcatctatgactacagagaacagcgctactacttcatggagatgaacacgcgtattcaagtagagcaccctgtcacagaaatggtgacgggaacggatctgatcaaagaacagatcaaagtggcatccggacaggagctttcgctcagacaggaagatgttgaatttaacggctgggcgattgaatgccgcatcaacgctgaaaaccctgcgaaaaacttcatgccttcacccggtaaaattaacatgtacctgccgccgggcggactcggtgtacgcgtggattcagccgcatatcccggctactcgatcccgccgtactatgacagtatgattgctaaagtcatcacatacggaacaacgcgtgatgaggcagtcgcacggatgaaacgcgcgctgagcgaattcgtgattgaaggtattgaaacgacgattccgttccatttgaaactgcttgaacacgaaacatttgtcagcggagagtttaatacaaagtttttagaaacatatgatgtaatgggctcataatttttgcgggaggtgaattgaatggaagacaacagtgtgcttaaaatggatcatgatgaggctcatttaggcaaggttgaaattgctcctgaggtcattgaagtcattgccggcatcgccgcttccgaagttgaaggagttgctgaaatgcgcggcaatttcgccacgggcgtcgtagaacgcttcggcaaaatcaatcacggcaaaggcgtaaaggtcgatttagccgatgacgggattaccatcgacgtctattgcgtcgttcaattcgggatctcgatcccgaaagtggcggcaagcgttcaggagaatatccgccaaaccttattaaacatgacgtctctgaccattaatgaaatcaatattcatatcgtcggcattcaatttgacacgaaagcccaagaagtcgaaatcgacgaagaaatgtaatgagcgtataaaaaccaaggggatgggcagccctttggttttttatacgtttcccgtcatttcaggcatgaagaaagccggcttacaaacggcagccgagtttcttcatgctgtgaaatccgaatgaaattaatgcgttttgtgaaaatattcggcattagggtaaaaaacctaaatttcgacatgcgattgagaaaaaaatatgttatgatctctttaagcttaacgacaagcggataaagcggatctgaaggagaaagaaaatgaaaagaagaacagctagagaaaaagctttgcaggcactttttcagattgatgtcagcgatattgcaccgaacgatgccattgagcacgcgcttgatggtgaaaaaacagatgccttctttgaacagctggtgtacggagtgatcgaacatcaggttcagcttgatgaaatgatttccggccatctcgtcaattggaagcttgaccggattgcaaacgtagaccgcgcgatcctgcgtctggcggtgtatgaaatggtttattctgacgacattcctgctaacgtgtcattaaacgaagcaatcgagctggcaaaacggttcggcgacgataaagctgcaaaattcgtaaacggggttctttctaacattaaaactgatatcgaatcataggaggaaagaaaatgactgcaacaatcatcgacggaaaagaaacggctaaagaaaaacgcgaacaattggcaaaagaagtagaagagctgaaagcacaaggcgtagtgcctggcttggcggtcattttaatcggagacgatcccgcttctgtttcatatgtgacaggcaagaaaaaagccgctgaaacaatgggaatgaaatttaagcttgaccgctttgactcaagcttaaccgaggcggagcttttaacagtgattgatcagtataatcaaaatccggaattccacggcattctcgtccagctgccgctcccggatcatatttctgaaaaagccgtaatcgagcggatctcccctgataaggatgttgacggtttccaccctctcaacgtcgggaaaatgctgcttggcgaagatacatttcttccatgcacgccgcacggaattgtcgagttattgaaaaagacgaacgtagatctttccggcaaagaagttgttgtagtcggacgaagcaatattgtcggtaaaccggtcggccagctgctgctgaacgaaaacgcgaccgtcacatattgccattcccggacgaaaaatatgtctgagcatacgaaaaaagcagatattcttgtggtagcggtcggtaaagcgaacttcatcaaagccgatcaaatcaaagagggcgccattgtcattgatgtcggcgtcaaccgtctcgaaagcggaaaactttgcggagacgttcagtttgatgaagcgaaagaaaaagcatctttcattacgccggtgccgggcggagtaggtccgatgaccatcacaatgcttgcgcataatactgttaaatctgccagacgtacgttatcatagataaccggagacagtcacaaaaagtgtgacaatgagcacgatacccgcttcttaaggctcctttcagccagagcgggttttcttagtttagggcaaaaagcctttatgaaaggagtgcaggatgtgagtgaagcggcatatgtcacggtttccgcgctgaccaaatacattaaacgaaaattcgatgtggaccctcatcttgaagacatttggattaagggtgagctctccaatgttaaaattcatacgagaggccacatctattttacattaaaagatgagcatgcccgcatgcaggccgtcatgtttcagaggcaaagttcgaggcttgcgtttaagccagaagacggaatgaaggtcatcgtaagaggcggcatctccgtctatgaaccgagcggaagctatcagctgtacgcgaaagaaatgcagccggacggtgtgggggcgctctacttagcatatgaagaattaaagaaaaaacttgccggcgaagggttgtttgatgaccggcataagcaggccatccccgcttttccggccacgatcggggtcgtcacgtcaccgacgggagcagccgtcagagacgtcattaccacactcaaaagaagatacccccttgtgaaagtcattgtgcttcccgcgctcgttcaaggtgaaaatgccagcagatcgattgtgaagcgcattgaagaagccaatgcacaaaaaatgtgtgacgtcctgatcgtcggaaggggagggggctcgatcgaagaattgtgggcatttaacgaagaaatcgtggcccgggcgatttttgcttccgccattccgattatatcagccgtcggacatgaaacagattttacaatcagtgatttcgtcgcagatatccgggcggcaacgccgacaggagcggcagaaatcgccgtcccccacacgacggacttaatggaacggacaaaaacggcggaagtccgcctgacaagagcgatgcagcagcatatcagcaagaaaaaagaacgggttcaatcgctccagtcatcctacgcgttccgttttccgaaacgattgtatacccaaaaagaacagcagtttgaccttttgtatcagcagttccaatcacagctcacggggcttacggacaggaaacaaaggcagctggagcggaatacgtacagattaacggcgctccaccctgaaacccagctgaaacaggcgaaaaaacggtacgaggagcgctcaaatcagctcgcccgaagcatgaatgtccagctgaagcagcttcattcgcagtttcagacggttcttggtaaactgaatgcattaagtccgcttcaggtgatggagagaggatacagcctggcctataaagacaaagagctgatcaaaagcgttgatcaagtggaacaaaatgatacgctagaagtaaagatgacagacggcgttctgacgtgtgaagtattgcaaaagagaggcgaacgataatgacagaaaccaaaaaaagtgaagagctgacatttgaagaggcgatgaaaggccttgaaggcattgtggcaaagcttgaagaaggagacgtgccgctggagcaggcgattaattattttcaggaagggatggccctttcaaaaatgtgccatgaaaagcttcagcatgttgaaaagcaaatggactttattttaaaagataacggcgaacttgcacctttcagcgttcaggaggaagacgaaggtgacaaataaactggacgcatttttagcatcgcgcaaacaactgattgaacagcagctttctttgtatacagaacggcttgcgatgccggaaaccctcaaaaaatctatgctgtattctttggaagcgggcggaaagaggctgcgccccctcgtcgtcttagccgttctgaatgcttacggaaaagatgaaaaagacgggattccggtcggatgcgctgtcgaaatgattcatacgtattctttaatccatgatgatctgccttgcatggacgatgatgatctgcgccggggaaagcccacaaaccataaagtcttcggagaagcggcagccgtattggccggagacgggcttctgacagaaagctttaaactgatcacatctcatgtgtctgaggcggtttcagcagaaaaacggctccgtctcgtcgatgagctgatcagcgcggcgggaacggaaggaatggtcggcggacaggctgccgacatggaagcggaacaaaagcggataacgcttgaggagctggaatccatccacgagcggaaaacggccaagctcctcggtttttccgtgacggcgggcgccattttggcagatgcgccggaggatgaagtcgaaaagctccgtctgttcagcagccatatcggcatcggattccaaatcagagacgacatccttgatattgaagggcatgaggagaggatcggcaaaccggtcggctcagacacgtcgaatgaaaagtcaacgtatccgtcgcttttaacgcttgaaggcgcgaaagaaaagcttgcgtatcatataagcgaggcgaaacagatcatcagcggcctttctcttcagaaagaattgctgcatgacctctgtgatttaatcgcggcgagagatcattaaaaacggtcctgatttgaaggggctgccgctcctatggtaaaatgtaagcagtttcgatgaaaatacaaagggagtctttttcttttttcaaaaagacactgtttaatttgcagaaattcatgctgaaagtgagttgatccgctttggatcttttatcaatacaggacccgtcatttcttaaaaagatgtcaattgaacagctggaagagctgagtgaggagatccgcaatttcctcatcacatcgctgtctgcctctggcggccatatcgggccgaaccttggggttgtcgagctgacaattgcgcttcacaaagaatttgacagtccgaaagataaatttttatgggatgtcggacatcagtcctatgttcataaactgttaaccggacgcggcaaggagtttgaaaccttgcgccaatataaagggctttgcggtttcccgaaacgcagcgaaagcgaacatgacgtatgggaaacagggcacagctcaacctcgctctcaggcgcgatgggaatggctgccgcccgtgatattaaaggatcgaaagaatatatcatcccgattatcggagacggcgctttaaccggaggaatggcgcttgaagcgctgaaccatatcggtgatgagaagaaagacatgatcgttatcctgaatgataatgagatgagcattgcgccgaatgtcggggcgattcattctatgctgggacggcttcgcacggccggcaaatatcaatgggtaaaagacgagcttgaatatttatttaagcgcatcccggccgtcggcggaaaattggccgccacagctgaacggataaaagacagtttgaaatatatgcttgtgtcaggcatgttttttgaagagctgggctttacgtatttaggcccggttgacggtcattcctaccacgaactgtttgaaaacctgcaatacgccaaaaaaacgaaaggccctgtcctgttacatgtcattacgaaaaagggcaaaggctataaaccggctgagaccgacacaatcggcacatggcacggaacgggtccttataaaatcaatacgggtgatttcgtcaagccgaaagccgcggcgccttcatggagcggacttgtcagcggcaccgtgcaggagctggcgcgcgaggatgacagaattgtcgcgattacaccggccatgccggtcggctccaaactggaagggtttgcgaaagaattccctgaacgcatgtttgatgtcggaatcgcagaacagcatgcggcgacgatggcggctggaatggcgcttcagggtatgaagccgtttcttgcgatctattcgacctttttgcagcgggcgtacgatcaggtcgtccatgacatctgccgtcaaaacgcgaatgtgtttatcggcattgaccgcgccggtttggtcggcgctgacggggagacgcatcaaggcgtctttgacatcgcctttttgcggcatataccaaacctcgttttaatgatgccgaaggatgaaaatgaaggccgccatatggtcaatacagcccttaattatgaggagggtccgatcgcgatgcgcttcccgcgcgggaacgggctcggcgtaaagatggataaagagctgaaaaccattccgatcggaacatgggaagtgctccgtcccggaaaagacgcggtcattttaacattcggtacgaccattgaaatggcgctggaagcggctgaagaactgcaaaaagaaggcctgtccgtgcgtgtcgtgaatgcgcggtttataaaaccgattgataaacaattgatgaaggccattcttaatgaaggtctgccgattttaacgatagaagaagccgtgcttgaaggcggattcggcagcacgattcttgaatacgctcatgacctcggcatgtatcatacgccgattgacagaatgggcatcccagaccggtttattgaacacggcagcgtaaccgccctgcttgaagaaatcggtctcacgaaggctgaggttatgaaccggatcaaactgctgatgccgccgaagacacataaaggaattggatcatgacagcaaaaaaagaacgattagatgtacttcttgtagaaaaaggccttgcggaaacgcgggaaaaagcgaaacgcgccattatggcgggcatcgtatactcaaatgaaaaccgattggacaaaccgggtgaaaaaatcgcccgggatcttccgttaacggtaaaaggaaaccctcttaaatacgtcagcagaggcggattaaagcttgaaaaagctctggaagtgtttcccgtctcggtaaaaggcaaaacgatgattgacatcggctcgtctacagggggattcacggattgcgccctccaaaacggagccgagcggtcctacgcagtggatgtcggctataatcagcttgcttggaagctcagacaggacgagagggtcgtcgtcatggaacggacgaatttccgctattccgagccttccgatttcacagagggtttgccggaatttgcgacaatcgatgtttctttcatctcactccgcctcattctgccggttttaaaaacgctgcttgtaccggggagcgattgtatcgcactggtgaagccgcaatttgaagccggacgggaatccgtcggaaaaaaaggcattgtcagagatcccggtgttcatactgacgttctccgccgcatgaatcaatttgccgcttctgaaggatatacagtgaaaggactgtccttctcaccgattacagggggagacggcaatattgagtttctgcttcatttggaatggggcggagaagacggaaacggcgctgaactgccggaagaagacattctccgtaccgtccgcgaagcacatgagacattaaaagccaaaaagacagatgtaccggaataatagggggctattattccttttttctgccatcatgtactttttatcaagaagcggttaacataatgacaagaacagcttgaaaacagaggtgcttacatgacaaaaggccaaaggcatataaaaatcagagagcttattacaagccatgagattgaaacgcaggatgacttagttgacatgctgagagaagaaggatataaggtaactcaggcgactgtctccagagacattaaagagctgcatctcgtaaaggtgccgacaaacaacggctcctacaaatacagcctgccggcggatcagcggttcaatccgctgtcaaaactgaagcgttcattaatggatgcgttcgtaaaaattgactcagcaagccatatgatcgtattaaaaacgatgccggggaatgctcaggcaatcggcgctctgatggataatctcgaatgggaagaaatcatgggcacgatttgcggagatgacacgatcttaatcatctgcaggacgcctgaagatacggagggcgttcaaagccgtcttttggagctgctgtagcgtaattatcagataaaaggtggaatgctgtttgttagctgaactatcaataaaaaactttgccattatagaggaactgacgatttcgtttgaacgggggctcaccgtcctgacgggagaaacaggggccggcaagtcaattattatagacgccgtttccctattagtcggcggccgcggctcgtctgaatttgtccgttacggtgaaacaaaggccgagcttgaaggactgtttcttttggacagcggtcatcccgtttttgaagtatgccgtgagcagggaatagacgcatctgacgacatgattgtcatgagaagggacatcaatgccggaggaaaaagcgtctgccgtgtcaacggaaaattagtgacgattgcggctttaagggaaatcggcagacttttattagatattcacggacagcatgataaccagctgttaatggaggacgacaaacacttggagcttttggataaatttgcgggtgctgaggccgaatccgcgcttcaggcttaccatgaaggctatgagcgttatatgaagctgctcaaaaaagtgaagaagctgtcagaaagcgagcaggaaatggcgcatcgattagacctgattcaatttcagcttgaagaaatcgagtcggcgaagcttgaattgaatgaagacgaacttcttcaggaagagcggaagcagatatccaactttgaaaaaatttatgaatcattgcaaaacgcctataatgcgctccgcagcgagcagggggggcttgactgggtcggaatggcctctgcccagcttgaagatatttcggatatcaatgaaccgctgcaaaagctgtctgaaagtgtgtcaagttcctattatctgctggaggatgcaacctttcagatgcgcaatctgttagatgatctggaatatgacccggaacggctgaattttattgaaacccgtttaaatgagatcaaacagctgaagcgcaaatacggagcgacggtagaagacattttggaatacggctccaaaatagaagaggaaatcgatcaaatcgagaaccgcgacagccaccttgaagcgctgaagaaggaattggagtcggtcggcaaagatgtggccgtagaagccgccaatttatcaaaaatcagaaaagcatgggctaagaaactggcggaagcgattcatcaggaattaaaaagtctgtatatgggcaaatcaacgtttgatacggaatttctcgtgaaaaccgatccgtcagccagtgaagcaccggttgttaacgggcagcccgtgcagcttacccaaaaggggattgaccttgtgaagtttttaatttcaacaaacaccggtgagcctttaaaaccgctgtcaaaggtcgcttccggaggcgagctttcaagggtgatgctggcgatgaagagtattttttcttcccagcaggatgtcacctccatcatctttgacgaagtggacaccggtgtaagcgggcgggttgcccaagccatcgcggaaaaaatccataaagtatcgaccggttcacaggtgctctgcattacacacctgccgcaggttgccgctatggcggatacgcaccttctgatcgcaaaagaattcaaagacggccggacgacaacgcatgtcacgccgctttctaaacaggacaaggtagcggaaatcggccgcatgattgcgggcgtcgaagtgaccgatctgacaaaacggcatgcacaagagcttttaaaacaggccggacaggtaaaaacgacaggataagctgctgatacaggcagcttatttttttgttccatttctctaacagtgtatccaatgtttttcttcgtatgccggttataaatcaagcgcaggaaggcaaaagtatagatgtagcagaaaaagaaagtggtgtgggataggagcgaggagagtgaaggaatgaatgcacgataacatgaggaaagcaataggtgtaattctccttgtttctttactaagtgtaggcttttttaagccatttaaagaatatttactgataccgtcagaaatgagcgtctttgaaaaccagacacaggccgttccggttaatgcatcaataagcgctgaaaagggcgaattatcagaagcctttacgctgaaagaagagcacggccatgcaaacataacagggcaaacacaaggccggtcagaagtagtatatgatcttgccggatttcccattaaaaaaacgaaagtgcgtgtccttccagaattgaaggtcattccgggcggacagtccatcggtgtaaaactgcattcagtcggtgttttggtggtcggttttcaccaagtgatgacaaaggatgggaaaaagtctccgggagaacaagcgggaattgaatctggcgacatcattattaaaatgaacggacataaaattgaaaaaatgagcgatatcgccccgtttattcaaaaagcgggcaaaaccggtgaatctttggatttattggtgaaacgcgataagcaaaaaatcaaaacaaagctgattccgacaaaggacgaagccgaggggaaatatcgaatcggcctttatatccgcgattcggcagccggcatcggcaccatgacattttttgaaccgaaaacaaaaaaatacggcgcattgggccacgtcatctctgatatggatacaaaaaaaccgattgttgtagaagacggagaaatcgtccgttcaactgtaacatcgattgaaaaaggaaaaggcggcaatcccggcgaaaaactggcaaggttttcgtcagaacggaaaacgatcggcgatattaaccgcaacagcccgttcggcatcttcgggacactgcatcagccgattaaaaacaacatttccgacaaagcgcttccgattgctttgtcaaatgaagtaaaaaaaggacctgcgcaaatgctgacggttatcgaaaacgataaagtagagaaatttgatattgaaatcgtcagcaccacgccgcaaaaattcccggcgacaaagggaatggtgttgaaagtgacagatccgaaactgctgaaaagaaccggcggaatcgttcaggggatgagcggaagcccgatcatccagaacggaaaggtcgtcggagccgtaacccacgtatttgtcaatgatccgacaagcggctacggcgttcatatcgaatggatgctgtctgaagcgggtgttgatgtttacgggaaagacaaagcaagctgactgccggatgatccggcagtttttttatgtgatgcgttcttcacttctttcctggattcatgtaaaataagacatgaagatttttcgacaaattcacgtttcctgatttgtcaaacttaatttttagtcgaaaaacctagaaaatgctagaaaaacaaagatataccactattattggtaaatatggattttttaaaaggggaagtagtggttttgtcgaatgtaacatgtagcagtcaaatgggttgcgtcctgttaatacattgggggaggaagaaacgtggagaaaattaaagtttgtgttgctgatgataatcgagagcttgtaagcctgttgagtgaatatatagagggacaggatgatatggaagtgatcggcgttgcttataacggacaggaatgtctttctttgtttaaagataagaatccagatgtgctcgttttagacattatcatgccgcatctggacggacttgcggttttggagcgtctgcgggaatcagagctcgagaagcagccgaacgtcatcatgctgacggcattcggtcaggaagacgttacgaaaaaagccgtcgatttaggcgcgtcctatttcatcctgaagccgtttgatatggaaaaccttgtcggccatatccgccaggtaagcggaaatgtcagcagtgtcacacaccgtgcgccgtctgcgcaaagcagcattatccgcagccagcctgagccgaagcggaaaaatctcgatgccagcattacaagcattatccatgagatcggtgtgcctgcccatatcaaaggctatctttatttgcgtgaagccatttccatggtgtataacgatattgaactcctcggcagcatcacaaaagtcctttatcccgacatcgccaaaaaattcaacacgaccgcaagccgtgtagaacgggccatccgccacgccattgaagtcgcatggagcaggggaaatattgattccatttcttcactgttcggatatacggtaagcatgacaaaagcaaagccaaccaattcagagttcatcgcgatggttgctgacaagctgagattggagcataaagcttcgtaacgcaagcttttggctagatgtctttttcgcgccttctcttccgtgcatgaacgcggaagagaaggcgttttgaaattttgctggcgaaaacaatggaaatcacccacgccggtacttgttctatacataaatgcgggatctatgccgtctacacgtataataccggagctgatattttaatgattttgccgtctctgaaataaaagcgggggacgcggcggcttaacacagataagacttcgtagctgatcgtaccgagcatttcggcaatttcatcaacggaaatctcggctcctttttgtttgccgtagatgacgacttcttctccttgtttgccctcattctcacctaaactgaccataatcatatccattgtcactctccccgccaccggcacccgtctgccgcggtgaagaataaacccgcggttggacagggcgcgggagtagccgtcagcatagccgattggaatcgtcgcgatgatttcacccggttcggcgatatatgtggcaccataactgacggtccggggctctgtcaccatggctttcacataagcgatacgcgcctttaaacttagtgcgggtgtgagatccacgaggttcagttcctttatcgaggcggacggatataaaccatataacccaatgcctaaacggatcatgtcggcgctgaattccgggaatgcgatagcggcggctgtattgcacatatgcacggtaggcagcgtaatgtcttgattttttaaaaagcggagaaagctgataaacttttcgtgctgcagcatcgtcagctcagtgtccggttcatccgctgttgaaaaatgtgtaaagatgccatcccatgacagatatgtactcgacttgagcgctttcaccactgctaaaagatcttcttccgtacgcacacccagccggcccattcccgtatccacattgatatgaatggacagccgtttcgaatctgcttctttttccaatatccgattcgcttttttgatccagctgacttgaaacgctgataatgttatgttccaaacggcagattttttcacacagctgagagctgtgaagccgagcacaagaataggtgccgtaattcccgctctccgtaacacaattccctcttcgacacttgcgacagcgagctcgctcgccccgctttccagtgcctgccgcgctacttccacagacccgtggccataagcgttcgcttttacgacggccataattttagacgtattcggaatatggcggcggatcgcccgtacgttcttttttatcgcatcaaggtcaacttcaatccaaacttcccggcaaagttttttcatcacgattccttctttccttaatgagtttcagtactcatgctttcaatctgcattctattcaccttgaactgaaatcattcaaaacaagggaaggtgatcgctgatgtttaaaaatcaaggtttcaggaaatcagtacgcctgctttatttatgctgaaagggctgcatggcagcccttaaattgacttcacaatattctgatctgaaaattgatgttcaaacattttggactggcttacagcattgttttgaatgacaatgccgatatttccccctcctgcaccgaaaacggtttttgatgcagtcagcggactgatggatatggcgccgccaacattgacaactccgtttcctgatacgttgtttatcgtaatcgggcaaccgctcattctattttttctcctttctctcacagtctactaactatatgtacgctgtgatatggaataagattaaacaaaacggcaaaaagaatccggctgctgccagccggaaagggagggaaatacggatgtcataatgttttcgttacattttgatcagagtattgagagcttgaagattgagatgtactggattgattcatttgcaggaccatccctgtatttcccccacctgagccgtagacggtttttgatacggttaaaggacttatcgaaaacgcaccgccgacattgacaaccccgtttccggaaagactgttaatcgtaataggaaaaccagccatcatatacggtctcctttctattaatctatttactatatgtacgctgtgtgttagaaataggagtaaacaaagcggtaaaaacttgtaaatcaaaaaaactgccggacatccggcagtttttttagtctacttttcaaacggcacccagccgcctgtattctgaatcatttcccataacggttcaggaagtcggtatttctcaatttcagatgcttgaatggctttttcgatttcctgttcgcggccttctttgaccagcaccgcccattcggggttaatcaaaatgacacgtcccagagccaccagcggaattccgctttctaatacagcaagcgcttcgtccgcggtatagatggaaccgacggccatcagcggcactttatggccgacgcgttcgtttaataaatccatccgcgtccgtgaagtatccgctccgcggcgggctttggaattgacatccatcagtgaaatatgcagataatccaagttctcttccgcaagcgcgtcagcgagcatggatgtttctttcattgtaagccccggtgtttccggctcttccggtgacaggcggtagccgagaacgaatggattttcagcgtgtgtatcaattgcctgtttgacagcgtcaacgactgcaagcgggaacgcaaggcgcttttcatggcttccgccccagcggtctgtgcgccggtttgttttcggtgaataaaattggtgaatcaggtacccgtttgccccgtgaatttcaacaccgtcaaagccggcttcaatcgctctgcgtgtcgcttcgccgaatgctttcacgatgtgctcaatttcttgttcggtgagagcccgggacgtttgtctcccgtcttcttctgagccgctcggactgacgacgtcgttgtttggcacgagttcaggagggcattccaatcctccgtggtgaatctgcacaacggctttcgctccttgagactggatcgcctgagcgagttttttcaagccgggaatgtgagaatcatcatagatgccgggctggcctggaaacgctttgccgtccggcgttacgtttgcacatgccgtaataaccatgcccatttcttttgaacggggagtaatgtagcttaattcacggtcggaaatcgttccgtcatcatttgatgaatagtgtgtcatcggtgcgactgaaatgcggtttggtatggtgacgccgctttcgaacgtaaaaggttcaaacagcggtttataagtttgcttcatcatttcgccttcttccttaggagtttaactcgtccgtattctagcttatgttttaattgtgtgcaattattttgcttgttcttcttcctgaagttatgaccggctgaaccatctaaacgaatgaaacggttttctccgttccttttcaggatctttatatcctcctgaaatttgatggccgatcgagctgaatatgacagcggcggcgaagaggagaatgatttttttcatatacatatcttctttcttatcttttacaaggttatttataagcatacgcttgtgcgaaaaaaccgtcaatttgtttttatttattcttttttccactttcctgcggcgaatatcgttccgatctgaatcacaacacttaacagagcgcacactgccacaactgtgttgctgtccatagaagacaccctcctttttgttaggttgatgtatcatatgacagctgtctctgttttgacaaaaccgtaatgcggtgtttcatatttttcaacacaaaaagggcgcttttttaagcgcctttacttttttttcagccggttcaaagcgatttgaacggcgatggcgtcatccaggtagccgatcggaaacatgtaatccggaatgacgtcggtcgctaaaatataatacagcagcgcgctcccgagaatcgcgcggtcttcagccggtgttgattcatccatatactgatgatgcatgtttttcaaatgatcaataaaagggccgacgctttcttcattgtccattttcttttgaaactcatcgcaaatcaggcgatggccctgctgggttttggcatattgttcatatctggtcagttcgcgctcaatttgctcccgggaaaaaggctgatcaaacatctcggccatattcagcatatcctgaatcgcgtgcatcgggtcttgcggcgcagcttctttttcatggccgatgtctatgcctgacgcctcaagcaattcctccagcggggtgcggagatgttttgaaaattcctgaagatgctttaaattggccttctgcttgccgtttataatccgggagatggtggccgtatcaatgtttgttaaggcgccgagttttctcatggagagcgagtgcttatcaagcagtgattttaaaaggggccccagtgtcgtatttttattttctgtcaagggtgtcacctcgtttccgccggaatgatgatcattaatcaataatttttgcagaaaaggtaccttttctgtgctgctgaataggatagtgtagattcaacggcacaacatgttgaaaagacatcaaagaatggagagaaacgaacatggcttggttattgattttaggtttggcagtgtcctcgagcattgataatttaggagtggggatgtcatacggcatcagaaaaatcaaaatatcgcatgcgtcaaatatgatgatcgcttttatctgttttgtattcagttatatcggaatttatttcggcaaatggatttcagccgtttcaccgggctttcttcctgtattgctggcggcgtttattttatctgtcatcggtatccgcatcattctgctggctgtgccgagaaaaacagcgcgtgttggcgcgtcaggaaaaaaaggccgttttgccggtctgctgcaaaatccggaggcagcggatgccgacggttcgggagaaatcggtatattggaatccatggttctcggggtggccgtatccgcaaatgcgctgaccaacggattaagcgcggggttgatcgggctttctcccgctgccatttccatcactgcggcggtcggaagctttttgaccatatggatcggctgctcgcttggaaaaaaagccgcgtcattgcgcatcggttcttttcatgtcggacagttcagcacggtgctgagcggagtgattattctcatcattgccgccaatacgctgctcttttaagttgtcccgttcattttatgaaaagctcaaaataaatatgaatgtttctattcgggagagcgcatgacgcggctctctttttttgccgatctgatattttttcaaaatgaacagaaagtcgtccgtttccgttaaattctgcatattcggccttcagacagaacttttttcatagactgattagcttgttttctttctaagttcaggtaaacagcaggtcagatagccttcgttccaaatatggaaaagcgctggaggaatggaggctccctttacaaatcggtcattctgttcaaagataaagccgaatgagaaaacgtgaggtgatctgtgtgaagtctgtcatacttctgatcttcaccgcatggctgttatcaggctgcgagtataccgtggaggctgatgcggcgccgtcatttacacaggaaggaacatttataaaagcggccggaaacgatacgatcgcggtcgaaattgacggagaaaggcaagaggtgaaggtgcctttcgctaagcggtttgaatgtcagtctctgcctgaacatacggcggtgcaaatcacctataaaaaagagagcaacggacaattacggcttgaggaactgaaaaaagaaacagatatgtgaaaacggggaggaaaaaacgtgggtttactgacaaaaagcgctgctgccttcggtgccgctcttcttctgcttgcgccgtctgcttatgcagctgaacctttgcaaggaaaaaccatttatatcgatgccggacatggcggagaagacagcggggccggcggaaatggactgcttgagaaaaacatcaatttagcggtgtcaaacaaggtgatcgccaaattggagacagaaggcgcaaaacctgttgcttcaaggactgacgatacttttttacgtttggacgagcgggtggcgaaagcaagcgccagccaatccgatttattcgtcagcctccatacgaattcagccgtctcaacggcatcgggcacggaaacgtattttaattcgacatatgaaggagcagacagcgaaaggcttgcttccgacatccagcagcagcttgtcacgtctttagggatgaaggacagaggcgtaaaagaagctcctttttatgtcattacatattcaaagatgccgagtgtgctggctgaattaggttttatcacaaatcctcaagatgcggacaagctgaaaagcgataacggacaagagcacgccgcggacgccgttgtaaagggaatcgaaacctattacagcggacagtaattataaaatatgtgtaaatagcgccctccttatgtgcataacgattataatagagaaaaccgatgacaaacacctgaggtgacacatatgacgaatatttttgcccaccggggggcgtcgggcgactgccctgaaaatacgatgcccgcattcaaaaaagcgattgaggacggggctgacggaatcgaacttgatgtacagatgacaaaagacggccggatcgtggtcattcacgatgaaaccctcgaccgcacgacgtctttgaaaggatttgtgaaagatacggcgtatgacaaaatcagaaccgccgatgccgccggaaaatggaaagatgcttttaaaggtgtcagaattccgcttttgtcagatgtgctgcgttttgcggaacgtggtgattttctgataaacattgagctgaaaaacagtgtattccgttacgaaggaatggaagaagaagtgattaaaaaagtcagatattacggactcgaaaagcgcgttattttttcttcatttaatcatgagagtcttgcggtttgccacgccttggcgcctgaaattgaacgggcggtgctgacaatggatgtgctgtaccggcctgaacggtatcttgccgccattcccgcttcgggttatcatccgaagctcggtacgccggcggtgagcgctgaagtgatcaaacatcttgcaaaacaccaagcggcgctccgtccgttcaccgtcaatcgtcctgaggatatgaagcagctgatgaaagcgggagcagacgcaatttttaccgattatccaaagctggctgtttctataaaagaagaatgccgcagctgagaagactgttcagacagtcttctttttttatgggcgggaaaaaggcggtgcactcataactcggtcagccggttcatatattgtaacagggcgttttgtgtaagcgttatcttttatcttattgaaagtgaggcaaaattgtgggaaaaacggttatcgtcagtgcggcaagaacgccgttcggaaaatttggcggcgcattaaaagaggtaaaggcagccgagcttggcggcattgccataaaagaagcaatcaagcgcgccgctatcagtgaaagcgaagcggaaggagcggtgatgggaatggtcgtccaggcgggtgccgggcagattccggcacggcaggccgcaagatatgccgggcttccgtggtccgttccggctgaaaccattaataaggtctgtgcatcagggctcagggccgttaccatctgtgatcaaatgatccgggcgaaagatgcggacgtgctgattgcaggcggaatggaaagcatgagcaacattccgtacgccattccggccggccgctggggtgtgaggatgggggacggggtgtttcaggatttaatggttcatgacgggctgacctgtgcgttcgaccaggtgcatatggctgtccacggaagcactgcggccaaaaagtacggcatttcccgggatgaacaggatcattacgctcttttgagccagaaacgcgcggctgaggcggccgaggcgggcaaattgcgtgaagaaattgtccccgtcacctggaccggcaaaaagggcaaacagcataccgttgaagcggatgaggggctgcgccctgatacgagccttgagcagcttgcagcgctcaagccaatttttacagccgacggaacggttacagccggaaacgctcccggtgtaaatgacggggccggagcatttgtgctgatgtcagaggaaaaagccgcgaagcagcatgtcaggccgctcgcagcgatacttggctttgcgtcagtcggactggaagcgtgcgagctggcaagcgcgccgggagaggccatcagccggctcttgacaaaaaccggactgtccgttgacgatattgatttgtttgaagtaaatgaagcatttgcgtccgtcgtgctcgtgagtgaaaaaatagccgggttcagccgggaaaaagtgaatgtaaacggaggggcaatcgcgttcggccacccgatcggcgcaagcggagcgagaatcatcatgagtttaatatacgaattaaagcgtcgcggaggaggtttaggcatagcggctatatgcagcggagcggctcaaggagatgccgtcctgcttgaggtgtactgatcaaaggagggagcgccggatgaaaatgaaaacaatcatggtcgcaggtgccggtcagatgggagcaggcatcgcgcagacggctgcagaagccgggtttgccgtcatgttatacgattgggagccggaaacggtaacaaaaggtcttcaccgcataaagacaaacctggagaaagagcaggcaaaaggacggaagtcacggcaggagacagatgccgttttcagccgtatttccccggcagaactcacagaagcgggagatgctgattttgtaattgaagccattgcagaaaacaaaaaagcaaaagcggaattgtttgacacactagataaaatctgtccccctcatgccgtattggcaagcaatacgtcttctcttcccattacggagcttgccgcggccacaaaaaggcctgaaaaagtaatcggcatgcattttatgaatccggttcctgtcatggagcttgtcgaagtcatcagaggactcgccacatcggaagaaacggcggaaacagtaaagaagcttgccgtccggatgaataaaacccctgtcgaagtcaatgacttcccgggctttatatctaatcgcatattaatgccgatgattaacgaagccgtttattgcctttacgaaggagcagcttcaaaggaagccattgatgcggtgatgaagctcggcatgcggcatccgatgggtccattaacattagctgacttcatcgggctggatacgtgcctttccattatggaggttctctatgcggggctcggagatccgaaataccgcccatgccctctgctcagaaaatatgtcagcgccggctggctcggcaaaaaaagcgggcgcggtttttatgagtacggcagatgacgtaaagatcatgaggggagacggcagccatgcattttacagaagagcacatcatgatgagaaaaatggtgcgtgattttgcccgcaaggaaatcgcgccggtggttgagctcatggaatcaacagatgaatttccggagcggctgattaaaaaaatgggcgaagcgggattgatgggcattcccgtcccggaaacttacggcggggcgggtgctgatacaacatcttacattttagcgattcatgaaatatcaaaagtcagcgcggccgtcggcgtcattttatccgtccacacatcggtagggacaatcccgattttgcatttcgggacagaagcccaaaaacaaacgtatattccgaagctggcagcgggcgaatatattggggcttttgcgcttactgagcctcaatccggatctgatgcgggcagcctgaaaacaacggccgtgcgaaaaggcggttcatatattctgaacggttcaaaaatctttattacaaacggcggagcggcagatctgtatctgacattcgccataaccgatccgggtaaagggagaaagggaatttcagcgtttatcgttgaaaaaaacacacccggtttttctgtcggaaaaaaagaaaaaaagctcggactgttaggttccaatactgtcgaattgcagtttgaccaagcggaaattccggttgaaaaccggctcggcgaagagggtgaaggcttttcaatcgccatgaaaaaccttgacgtcggacggatcggcatagcggctcaggcgctcgggattatcgaagcggcgctcggctgctcggtggagtacgccaaaacccgcagccagttcggcagacccatcgcttcgaatcaggccgtttcatttaaattatctgacatggcgacgaatgcggaagctgccaaattattggtctatcatgctgctgatctgtatcagcgagggcttccgtgcggaaaagaagcatctatggcgaagcaattcgcgtccgatgcggcgatgaaagcggcggtggaggctgtgcagattcacggcggctacggctatatgaaagagtatcccgcggagcgtttatttcgggatgcgaaagtcacgcaaatctatgaaggaaccaatgagattcaaaggctgattatttctaagtatcttcttcaataaaaagtgcgcaaaggagcgaaaccatggaatcttattctcccggtttagatggcgtcatagcggtggaaacggggatttctttcctggatacacagcagggcagtattttaatcaaaggccacgatctgattgagctttctaaaacggccggctatatggacattgttcatctcttattggaagacagacttcctgatgcgaaagagaaggcggcgcttgaagaagacgttcggcgcggcgggcaccttcccgaggaaatcttgcacatatgccgtctgctgcctgaacatactcacccgatggacggactgaggacgggtttgtccgcgcttggaggctttgacaaggacatcgatgaccgttcatcttccgtaaatcagcaccgcgtacgcggactgataggcaaaatgccgaatctgacggtcaacagctatcgagtcatcaacgggctggagcctttggcgccggtcggaaccttatcatacagcgcaaactttttatatatgattaccggaaaaacaccgtcatctttggaagaagaaatcttcgacaggtcgcttcttttatacagtgagcatgaattgccgaactcaacgtttacggcccgtgtcatcgcttcgacgcaatcggatatttacggcgcgctgaccggagccgtcgcctcgcttaaaggaaaccttcacggcggcgcgaacgaagcggttatgtacatgcttgaagaagcgaaggatacagacgggtttacacaattattaactcaaaaactcgcaaataaagaaaaaatcatgggcttcggccaccgtgtctacatgaaaaaaatggacccgagggcgctcatgatgaaagaagcgttaaaaaagctgtctgatctttcaggtgatttccgtctttatcatatgtgtgaagccggcgaaaccgtcatgcgggagaaaaaaggcctttatccgaatttagattactacgcagcgccggtctattacatgctcggcatcccaataccgctgtacacgcctatattcttcagcgcacggacggtcggactgtgcgcccacgtcattgaacagcacagccgaaaccggcttttccgcccgcgtgtccgctataccggagcgcgcctgtaaacagatgagaaaggaagatgaaaacatgacagaaccccgccgaatggacgctgtaatcgaagagatttctgactacgtgctccatcaggagattgacagttcagaagcttttactacggcaggacatgtgcttcttgatacgataggctgcggaattttggcgctcagctatcccgaatgtacaaagctgctcggcccgattgtcccgggaacctccgtgcccaacggcagcagagtcccgggcacgccttttgttttagacccggtcacggctgcttttaatatcggctgtatcaacaggtggctcgattataatgatacgtggcttgcggcggaatggggtcatccgtctgacaatctcggaggcatattggcttgtgcggattatatatccagagtgcggatttcagaagggaaagaaccgcttaccgtgcgcgatgtgctttgcgcaatgatcaaagcgcacgaaattcaaggaattctcgctttggaaaacagcttaaacagagtggggcttgatcatgtgctgtttgtgaaagtggcgactgcggctgtttgcgcacaaatgctgggcggctcaagagaggaaatcaataacgccgtatctcacgcttggattgataattcaagcctcagaacgtatcgtcatgcgccgaacaccggatcacgcaaatcatgggcggccggcgacgcgacgagcagaggcgtatatttggcccttatggcgcaaaaaggtgaaatggggtacccgacggctctgaccgcatctgggtggggatttcaagacgtattgtttaaccggcaggaaatgaagcttgcccgcccgcttgggtcctatgtgatggagaatgttttgtttaaagtatcctacccggctgaattccacgcccagacagcggcggaatgcgcggtccggcttcatccggaggtgaaagaccgcatcgaagacattgataggatcacgattatgacccatgagtcggcaatccggattatcgataaaaaagggccgcttcacaatccggctgaccgggatcactgcctccagtacattacggcaatcgggctgcttttcggagatatcacggcggatcattatgaagaggaaacggcgtctgacccgcgaattgatacattgcggagtaaaatggaggtgacggaacacaaagcgtactcaaaagattacttagacccgaataagcgatccatatcaaatgccgtacaggtgcattttacagacggcacggctacgggacggattgaatgtgaatacccgctcgggcaccggttccgcagaaaagaagccgttccgaagattcttgccaagttttcagcaaacatcagcactcatttttcattgaagcagcagcgtaaaatcgaagaggcctgcgaacactgcggccgaatgcagaagctcagcgtcagtgaatttatggacttatttctcgtataaaataggagggtgacaaacatgacgtggatcgtcagcaagcagtcgtctcaagaggagcttgcagagcggttccgtacgctgatggcagcgccggatctattgcagatccccggcgctcacgatgcgatggccgctcttatcgccaagaaaacggggttttcggctctttatttatcaggcgcggcttacacggcgagcagagggctgcccgatttagggatcatcacgtcggcggaaatggctgaacgggttaaagatttggtccgctcgtctgatctgcccgtccttgtcgatattgacacgggtttcggaggagtgctgaatgccgcccggacggcgaaagaaatgtatgaagcgcgcgcggccgccgtccagatggaggatcagcgcctgccgaaaaaatgcggacatctgaatgggaagcagctcgtgccgattgaagaaatggcgcaaaaaatccaagcggtcaagcgggccgcgccgactcttcttgttgttgcgagaacagacgccaggcagcaggaaggattggagggggcattaaaaagggcgtccgcttatataaaagcgggtgctgacgctgtttttccggaagcgctccaatccgaaagtgaattcagagcgttttccaaacaaatcagtgtgccgattctcgcaaacatgactgaattcggaaaaacgccgtattacagtgctgatgaattttccgatatgggctgtcagatggtcatttacccggtcacgtcactcagaacggcggccaaggcttttgagcgcattttccgccttctgaaagaagaaggctcgcaaaaagaggggctttctgatatgcagacgagaaaagaactatatgaaacgatcgcttacgatgactatgaagaactggatcaatccattgccaaaacaatactgccggacgactgaaaaagccctttttttgcaagggctttttttacagcttttttttcctgaaccgcgggctgacttgattgcgtttccgatctctgtacagaataaatccggccagaacataaaggccgaacaaaaaaaacgccaatccggccgccccctgaagaaaaagggacggaaacggggaaaacgcatgcccgaataatgcatctctcatcagcttaatgccgagcgccgcgacagcgccggggaggaccagaattaaaagcgcaacaagccggctcatattcagaaaacccctttacgatatgttttcctttattgtccaatcgaaaaaatattttgtcaagagatcaaaacgtggtaacataggggttgtgcaaattattgcaacgggaaatacaggtgtgcaaattttttcatataaaggggtatcgggatgcagaaggtgctgattataggtgctggtaaaggaggcacggcgctcctacagattttgatgaaaacaaagctgatccggattattgcggtggttgatcaagatccggaggcgcaagggctgcaagaagcccggaaatatggaattgcaacctcatcagattggaaaccctacataactgaagatatagatattatcatccatacaacaggcgataaagcggtcatggatgagctgctccatgagaaaaaagaacaaaccatcgtcatgccgggaaaattggcgtacatggtgtttcagctgatggaggaaaaacagcagcttatccaaatgctgaagtcgcagacgtataagcatgaccggatttttaattcaacgcacgacggcatgatttttatagacgtcaacgaaacgatcattttatttaatcagatggctgaaaaaatggtcggccaaaaacgggaggatgtcatcggccgccaaattaaagatgtagtgccgaacacaaagctgccgcggattctggaaacgagagagccggaatataaccagaagcagcttctcggaaagcacctgcagattgtcacgacaagactgccgatcattgatgaaggcggaaaacttctcggcgcgttatgcgtgtttaaagatatcaccgacgcagttgaactggcggaagaggtcacgaacttaaaacaaatccgcaccatgcttgaagcgattatacaatcatcagacgaggccatttctgtcgttgatgaaaacggcatcggaatgttaatcaacaaagcgtatacaaaaatgaccgggctgtcagaaagcgaagtcatcggaaaacccgcttccaccgatatctcagaaggggagagcatgcacctgaaagtattggggacaaggcggcccgtgcggggtgtgagaatgaaggtcggccccaataaaaaggatgttatcgtaaatgttgcccccgttattgtggacggtattttaaaaggcagcgtcggcgtcatccacgacgtgtcagaaattaaaacgctgactgctgagctgaatcgggcgcgccagatcatccgcacgcttgaagcgaaatacacgtttgacgacattatcggcacgagtgaacaaatgctggtcgcccttgaacaggcgaagctcggggcgaaaacgccggcgacgattctgctgcggggagaatccggcacaggaaaagaacttttcgcccacgccatccataatgaaagcgaccgaaaatacaataagttcattcgggtcaattgtgcggccctgtctgaatcactgctagaatccgagcttttcggctatgaggaaggcgcgtttacgggcgcgaggcgcgggggcaaaaaaggactttttgaggaagcgaataacggcagcattttcttagatgaaatcggagagctgacccaaagcacccaggcaaagctgctcagagttctgcaggaaaaagaaattatcagagtcggcggcgctaaagcgatttctgtcaatgtcagaattatcgcagcgacaaacgtcaacatcgaaaaggccatggcggaaggcgcgttccgtgaagacctgtattaccggattaaccgctatccgatctcaatcccgccgcttcggcagcgcaaagaagatattgaagcgctgagcattcggctcattgaaaaaatcaatcaggattacggccgcaatgtaaaggggctcacgccgaacgcgctgcgagctttatcagcctacagctggccgggaaacgtccgggagcttgaaaatgttctcggacgggcaatgatatttttagagccgcacatggaacggatcgaacagcagcatctgcctgtttttgaatcagagctgaatgaaaaaaacggcacccaaagtgattttccggatgtggaaggggaaaagctgtctcaggctgttgaaaaatttgaagcgcacgtcattcaaaaaacgcttgaaaagcataaattcaaccgaaccaaaacggcaaaagcgcttggtgtcagcattcggaatctgtactacaaaatggataagtacggccttgcaaatgacggcatgcaataaattgcagagaaagcgcaaacagctgcatgttttcttgaagaaagccggaataaaccctcccgcatatttggcacggaacttgcattgttaaaagcggattcgcacaaggaaggtggtacaaaatgaagctgagagacctagttgaaaaagccgcggcaaaaaacgcaaaaaccattgcagtggcccacgcagcagataaagaagtgatccaggccgtcaaaatggcggcagaacacttgtcggcacgatttttactgacgggtgacagcggaaagctgaaagagcttctcgcaaatgagccgaagttcaatgctgaaatcatccacgccgattcacccgaagaatctgcggcaaaagcagtgcgcgcagtgcgtgaacaagaggcggacgttttaatgaaagggaatctcccgagctcaactcttctgaaatcggttttaaaccgccatgaagggcttcgttcaaaaagggtgttatcacatgtagctgtttttgaggtgccggactatgaccggctgatgtatgtgactgattcagcgctgaacattgccccgtctcttgaagagctcgggcatattctgcaaaatgcggttcatgtcgcacattcagtagggaatcctatgccgaaagccgcagtccttgccgctattgaaacggttaatccgaaaatggaggtgacgctgaacgcggctgcgatcgtccagatgtgcaatagaggacagattaccggctgcattacggacggaccgcttgctttggataatgccgtatccaaagcggctgcgctgcaaaaagggatttccggaagcgtagcgggccaggcggatattctcttggttccttcaatcgaggccggaaatatgctttataagtcaatgatttattttgcgaaagcaagtgttgctgccgtcatcgccggtgcaaaagcgccgatcgcattaacgagcagagcggataccgcagaaaataaactgtattcaattgcgcttgcgatttgcgcatcacaagaacagtaggaggaacgaacctatggaaatttttaaatatatggagacttatgattacgaacaattggtattctgccaagatgaacaatccggattaaaagcgatcatcgcgattcatgatacgacgctcggccccgcactcggcggaacaagaatgtggacatatgacagtgaagaagcggcgattgaagatgcactaagactcgcaaaaggcatgacttataaaaatgcggctgccggtttaaacttaggcggcgggaaaaccgttattatcggagacccgcgcaaagataaaaatgaagaaatgttccgcgcgttcgggcgctacatccaaggcttaaacggaaggtatattacggcggaagacgtcggcaccaccgttgaagatatggacatcattcatgatgaaacagactatgtaaccggaatttctccggcattcggttcatcaggaaatccgtccccggttacggcgtacggcgtctacaaagggatgaaagccgcagcgaaagcggcgtttggcactgattcactggaaggtaaaacaattgccgtgcaaggcgtgggaaatgtggcttacaatctatgccgccaccttcacgaagaaggcgcttctttaatcgtaacggatatcaataaagaatctgttaaacgtgccgttgaggatttcggcgcccgcgcagttgatcccggcgacatttactcacaggcgtgcgatatttatgccccatgtgctctcggcgccgtcattaacgatgacacgattaaacagctgaaggcgaaagtcattgcgggagcggccaataaccagctgaaagaaacacgtcacggcgataccattcatgaaatgggaatcgtgtacgctccggattatgtcatcaatgcaggcggcgtcatcaatgtggccgatgagctttacggctacaatgctgagcgggctttgaaaaaagttgaaggcatctatgcaaacattgagcgggtgctcgatatttccgcgcgtgacggcattccgacatacttagcggccgaccgtctggctgaggaacgaattgagcgcatgcgccgttcaagaagccagtttctgcaaaacggccaaagtatattaagcagacgataggaatttgatctggaggtatgaaaatgttcgaaaaggaaaaacgcattctcattctgaatccaggctcaacatcaacgaaaatcggtgtctttcacaatgaacgctgtatctttgaaaagacgctgcggcatcccgaagaagagctgaaaacatttaacagcatcatcgaccaatacgaatttcgaaaaataagcattcttgagtctttgcacgaacagggcatcaacatttcaaagttcgatgccgtttgtgccagaggcggcctgctcagaccgattgagggcggcacatatgaagtgaatgacgccatgatcactgatttgaaaaacggctacaacggccagcatgcttctaatctgggcggaattattgccagggaaatagctgacggattaaatatccccgcgtatatcgtcgatccggttgtggtggatgagatgactccgctcgctaaagtatcaggaatgcctgaaatcaagcggaaaagcattttccatgctttgaatcaaaaagctgttgcccgtcaggcggcggcgtccctcggcaaacggtatgaacagatgaagatgatcgtcactcatatgggcggcggcaccacagtcggtgtccatgattgcggacgggtgacggatgtcaacaacgggcttcacggagaaggacccttcagcccggagcgcgcgggaactgttccggcgggtgatttggtagaaatgtgtttttccggcaagtattcaaaagccgatatgatgaaaaaacttgtcggcacgggcggactctccggctacctggggacaacggacgcggtgaaggtggaaaaacgcattcaggccggagatgaaaacgcgcgtctcatttatgacgccatggcttatcaagtagcaaaagaaatcggggcggcaagcgccgttttaaaaggaaaagtagacattatcgtcctgacgggcggattggcgtacgggaaaagtttcgtatccgccatcagatcgtacatagattggatttcggatgtactggtgtacccgggagaaaatgaactgcaatctctcgcgcaaggcgcgcttcgggttttagccggtgaggagcagtcaaagcaatatcagatcggcgaaggagtgaaaacaaatggcgactgagtatgatgtggtcattctgggcggcggcacgggcggttatgtagccgccatcagagcggcccagctcggcttaaaaacggccgttgtagaaaaagaaaagctcggcggaacatgtctgcataaaggatgtatcccgagtaaagcgctgttaagaagcgcggaagtgtaccgaaccgcaaaggaagcggcagcattcggcattgaaacggaaggtgtctccctccgctttgacagcgtgcaaaaacgaaagcagggaatcgttgaccggctggccggcggtgtcgcccacttgatgaaaaaggggaagattgatgtattcaacgggtacggacgtatgctcggcccttccatcttctcacctctgcccggtacggtttccgtcgaatacgcaaatggtgaagaaaacgacatgctgataccgaaacaattgattatcgcaaccggttcaaggccgaaaatgctgccgggtttagaagcagacggtacatatattctgacatcagatgaagcgttagagcttgaacgtctgccccaatccatgatgatcgtcggcggcggtgtcatcggaattgaatgggcatccatgctgaacgatttcggcgtcaatatcactgtgattgaatatgcggaccgcattttgccgacggaagaccgtgatatttcaagcgagatggaaaaactgttaacgaaaagaggaattaaggtcgtgacgggtgcgaaagtgcttccggatacattggaaaaagcggacggcgtttcaattgccgctgaaaagaatggaaaaaaagaaacgtatcacgcggaacaaatgcttgtttccatcggccgccagccgaacattgaagggatcgggcttgaaaacacggatattgaagcggaaaacggttctatcatcgtgaacgaagccgggcagacgaaggaatcgcacatttatgcgatcggtgatgttgtcggcgggctgcagcttgcgcatgtggcctcccgtgagggcatcattgccgttgagcatatggcgggtcttaatccggctccgcttgatgccgctcttgtgccgaaatgtatttattcaaatccggaagcggcgagcgtcggtctgacagaagaggaagctcttcgaaaagggcatgaactgaagatcgggaagtttccgttcatggcgatcggaaaggctcttgtatacggagaaagcgacggctttgtcaaaatcgtcgccgatcggaatacagatgatattctcggtgttcatatgatcggcccgcacgtcaccgatatgatctctgaagcggggcttgccaaggtgctcgacgcgacgccttgggaaatcggccagtccatacatccgcatccgtcgctttcagaggcgattggagaagctgcgttagccgcagacggaaacgcgattcatttttaaaaggaaagaaggaggggtttgaatgactacaaaccgccatcaagcattagggctctctgacgaagaagccgttgaaatgtatagaaccatgctgttagccagaaaaatcgacgaaagaatgtggctcttaaaccgctcgggcaaaattccgttcgttgtttcatgtcaaggacaggaagcggcgcaagtaggcgcggcctatgccttaaaccgtgataccgactatgtgcttccgtactacagagatataggggttgtgcttgcattcggtatgactgcaaaggatttgatgatgtcgggttttgcgaaagcagctgacccgaactcaggcggaaggcagatgccgggccacttcgggcaaaaggaaaacagaatcgtaacgggctcatcccctgttacgacgcaggttcctcacgcagtcggaatcgcgcttgcgggacgcatggataaaaaggatatcgtctctttcgttacctttggagaaggatcttccaaccagggggattttcacgaaggggcaaactttgccgccgtgtataaactgccggtcattttcatgtgtgaaaacaataagtatgccatttctgtcccgtatgacagacaggtggcgtgcgagaaaatatccgaccgggcggcaggctacggcatgccgggagtcactgttgacggaaacgacctgctggaagtttaccgggccgtaaaagaagcgcgcgaacgggcgtctaaaggcgaaggccctacattaatagaaacggtttcctaccgtttgacgccgcattccagtgatgacgacgacagcagctacagagaacgcgaagaagtagaagaagcaaagaaacaagatccgcttcttttatacaaagcatacttgcaagaagccgggcttctaggtgaagaagaagaaaagaccatgctggatgacatcatggctatcgtaaacgaagcgacagacgaagcggagaaagcgccatacgcatctcctgaatcaacgcttgatcacgtttatgcgaagtagggaggaatacttatgtctgtaatgtcttatattgacagtattaatgcagcaatgaaagaagaaatggaaagagatccgcgcgtgtttgttctcggggaagacgtcgggagaaaaggcggcgtgtttaaagccacggcgggtctctatgaacagttcggagaagagcgggtgatggatacgccgcttgctgaatcagcgattgccggtgtcggcatcggcgccgcgatgtacggcatgcgcccgattgccgagatgcagtttgccgatttcattctgcctgcggtcaaccaaatcatttcagaagcggcaaaaatacgctaccgttcaaacaatgattggagctgtccgatggtcatcagagcgccttacggcggcggcgtgcacggcgcgttgtatcattcccaatctgtggaggctatttttgccaaccagccgggccttaaaattgtcatgccttcaactccttatgacgcaaaagggttgttgaaagctgcagtccgtgacgaagatccggtgctgtttttcgaacataagagggcgtaccgtctgattaaaggcgaagtccctgcggatgattacgtccttccgatcggaaaggcggatgtaaaacgcgaaggcagcgacattactgttattacgtacggattatgcgtccattttgctctgcaggctgccgagcgccttgaaaaagacggaatttccgcacacgtattagatttgcgtacggtttatccgttagataaagaagccatcattgaagccgcgtctaaaacgggaaaagtattgctgatcacagaagatacgaaagaaggcggtattatgagcgaggtcgccgccattatttctgaaaactgcttatttgatttagacgcgccgatcaagcggcttgcaggtcctgacgttccggcaatgccttatgcgccgacaatggaaaaatacttcatgatgaatcctgacaaagcagaagccgcgatgagagaattagcggagttttaaagacgtaaggaggtttttgacatggcgattgaacaaatggctatgcctcagctcggagagagcgtgacggaagggacgatcagcaagtggctggtatcccccggtgatcaagtgaataaatatgaccccatcgcggaggtcatgacggataaagtgaatgcggaggtgccgtcttcttttaccggtacgattacagaacttgtaggagaagaaggccagactcttgcagtcggcgagatcatctgcaaaattgaaacagaagaaacggaaaccgaagaggcgccgaagcgggaagaagagcagaataccccttcagacaccggtgcaaaccgtcaaggtaaagatcagtcaaataaagcgcgttattcgccggctgtgctcagattagcgggagaacacggcattcagcttgaagaagttgaaggaacgggtgcaggcggaagaattacgcgaaaagacattcaaaagatcattgattcgggaatgaagcagaagtcggaagcaccggcgccggctgccgttcaaacaacgcaacaagcgccgaaacaacagcaaaaacaagcgccggcacccgctctgtcagccggtgatattgaaattccggttacaggcgtcagaaaagccatcgccgccaatatgcataaaagcaaaacagaaattccgcatgcctggacgatgatggaagtcgacgtcacgaacatgacggcgtacagaaacagcattaaagactcatttaaacagaaagaaggcttcaatttaacgtttttcgctttctttgtaaaagcggcggcgcaggctctcaaggagttcccgcagatgaacagcatgtgggcgggagacaaaatcgtccaaaagaaagacatcaacatctccattgccgttgccacggaagattcgctgtttgttccggttattaagcatgctgatgaaaaaacgattaaaggcatagccagagaaataacggaccttgcgaaaaaagtgagaaacggaaaacttactgcggaagatatgcagggcggcacatttaccgtcaataacacgggatctttcggctcagttcaatctatgggcattatcaaccatccgcaggcggcgattcttcaggtagaatctatcgtcaaacgtccggttgtcatgaataacgggatgatcgccgttcgtgatatggttaatctttgcctgtctttagatcacagagtgctcgacgggctcgtgtgcggccgattcctcggacgcgtcaaagagatcttagaaaacattgatgaacatacttccgtctattaaaaaaaactccttttgcccgggcggcaaaaggagtttttttattttcattgtgaatcctcgggaacaatcatagtgagatgatgttttttcacttcgatcgtacaaggtgttgttccgtatacctcgccatctgtatccgcgtccatctcacgtccggtttcgatttcaatcctggaggcctgaatataggacagctcccctttgaaatcatcaaacgaaccctgctccatcgtcatcagctcccgcaacgcggcaaggcttgtgttgcggcagattaacacatcggctaagccgtcctggaggctggcatcaggcaggggaactctgtttgtcccgatataatgcccgttcatgacaagcaccattacggcttcgtcttctttcacctcgccgtcaatcgtcaatttgacaggaaacgggttcgcgcttgtcatcgtccgcaaggcgctcgtgaagtagctgattttaccaagccatgctttttcagtttcattaatatggcttgatgcttcggtgatcagtccgatgccccagaagttcagaaaatagccgtcatccgttttacagacgtcaatcatccgtttatgtccggccgcgagcacttcagcggccttttgaaggttttgcgggatgccgagcgcccgggagaaatcgttgcacgttcctcccggcaaaatgccgacagcgggtctgtgatcaagcttgctgatgctgttgatgcattgatgcacagtgccgtctccgcctaaaatatataaatggtcaactgaactgtcgagattttcacaatactgacgggcatcatcctgatgtttggtcggtttaatcaaaagttcatcagctgactgggccaaaatggggacgaccgtgccgagcgttttatcaatctgtttttgaccggcgtttccgttataaattaaaactgctttccgttggctcatatgactgctcctttatttcagacaatctccttaacaagtttcccgtttttaaagggtcataaacttacatcgggaacataaaagggacaaaaaacaattggatatgagcggtgtcatttgccgatagggaggttccttgctatcataagaagagatgatcaaaaaggagaggtcccaattgaatatggattttaatttatttatgaatgatgtcgtgcgtcaagcccgccaggaaatcacggccgccgggtatacagagctgaaaaccgctgaggaagtggacgaagcgctttcgaaaaaaggaacgacactcgtcatggtcaactctgtatgcggatgcgcaggcggtattgcacggcctgccgcgtaccattccgtacattacgataaacgcccggatcagcttgtgacggtatttgccggacaggataaagaagcgacagccaaagcgagagaatactttgaaggctatccgccgtcctctccgtcatttgccattttaaaagacgggaaaatcatgaaaatggtggaacgccatgaaattgaaggccatgagccgatggccgtcgtcacaaaactgcaggaagcatttgaagaatattgtgaagaagtataagtgaaagaaaaaccccggagccaagcgcttgcggggtttttttatatggcatctgtataaatataaatgtttatacatcggcgttcagctgtcactaacctgaaaaacaatgactataataaacacagaaaggaaaatatatttttcaaaaatagtattgcatcacaattaaaaagtgtttaaaatacaagttaacgaataaatattcaaatttaagagatcagtagatatgggggaaatgaatcatgaagaaatggctgttggtattagctgccgcatgtatcacctttgcgctgtccgcttgcggatcaggcaattcaggctcagagggcggaaagaacaagctgattatgggtacatcggctgactataaaccatttgaatataaagacggcgatcagatcaccgggtttgacgttgatctggcaaaagctctaggcaaaaagaccggctatgacgttgaggtgcaggacatggacttcaacagcctgattacagccttgaagtccaagcaggtagatatgattttatctggaatgacacctacaccggaacggaaaaagcaagttgatttttctgatatttattatactgctaacaatatgatcgttacgaaaaagggaagcagcatgaaatccctgaatgatctgaaaggcaaaaccgtcggtgttcagctcggctccattcaagaggaaaaaggcaagaagctcgcttcgaaatacggttttcagctcgaagaccgcaaccggatctcagacttaaccgaagagatcaaatccgggcgttttgatgccgcgattatcgaagacatcgtagcacaaggctatttcagctcaaatcaagatctgcagggctttgcgtcagcagatgcgaaatcagacgaatcgggttccgcgattgcgttccgcaaagacagtgatctgacagcgaagttcaacaaagcgctgaaagaaatggagaaaaacggagaaatcgaaaaactgaagaaaaaatggttcaccaacgagaaataaaagaaagctcaacttttcgttgagctttttatcttgaataaagacaaaggagatcacacgtatgaatttggatttctcagcgacaatcccccaaattccttttatattggaaggccttgcggtcacattaaaaattgtgctcgtttcagcggtcatcggtcttgtattaggcatcgtgctcagcttatttaaaatcagcacgatcagtccgctgaaatggattgcggatttttatacttcgatattccgcggcacgccgctcgtgctgcagctgatgatcatttatttcggtatgccgcagcttctgggctttcagatcgatcaattttgggcggcggtcaccgcattatcgctcaattcagccgcttacgtctctgaaattatcagagcgggaatcaacgcaattgacaaaggacaaaaagaggctgccgtcgctctcggcgtgccgtacggaaaaatgatgaaagatctgctgctgccgcaggcgtttaaaaacatttctccggctattattaacgaattaatcaccttaacgaaagaatcggcgatcgtcacagttatcggtcttggcgacattatgagacgggcctaccagtccggtgccgcaacatacaactatttagaacctcttattgtggcgggcttaatctattacgtgctcgttttgatcttagcattcatcggaaaaggcgtagaaaggaagctgaaagccaatgattaaggtcgacaacctgtcaaaatcattcgggaaacatgaagtactgaaaaacatttcaacacagatcgaagaaggggaagtcgtcgctgtcatcggtccttccggttccggcaaatcaacgtttctgcgctgcttaaatctgctggaaaacccaagcggcggaacgattgccattaaagaaaatgaaattaccgcagctaaaacgaataaactgaaagtgcgggaaaatatcggcatggtatttcagcattttcatttgtttcctcataaaacggtgcttgaaaatatcacatacgcgccggtcagcgtgaagaaagagtctaaaaacgaggcggaggaaaaggcgtgcgccctccttgaaaaagtcggactgcttgacaaacggaacgactatccgaaccgtttgtcaggcggacagaagcagcgggtcgccatcgcgcgggcgcttgccatgaatcctgacatcatgctgtttgatgaaccgacctcggctcttgacccggaaatggtcaaagaagttcttgaggtgatgaaagagctcgcgcagacgggcatgacgatggtgatcgtaacgcacgaaatgggatttgccaaagaagtggcagaccgcgtattattcatggatgaagggacgatcgtggaagacgggcagccggaagaattttttctttctccgaagtcaaaaagagcacaggactttttagaaaaaatattataaaatataactggaagaaaagaagaagaatgctcttcttcttttttttgagaaagaaacaaacagaatggagcaagcaatgtttaaaatcggttaccgcacactaaagaccgcacttggaacggcgctggccatttatttagcccagctgttgcatctgcaaaacttcgcatccgcaggaatcatcaccatattgtgcatccagattacgcaaaagcggtcgcttcaggcctcgtgggcccgatttgccgcctgtttattggcgatcgtcttctcatatgtctttttcgggctgatcggctattatccgtttgcgatcggaatattgctggtgctgttcattccgactacagtcgttttaaaaataaacgaagggatcgtcaccagctcagtaatcattcttcatttatatatgtccggcggcattacgatggcgtttatctggaatgagttccagctgatcaccgtaggtatcggcgtcgcgctgttaatgaatctgtatatgccgagcctcgacagaaaactcgcggcgtaccggaaaaaaatcgaggacaacttttccgtcatcttcgccgaaatcgaacggtatttgttaactggtgagcaagattggtcggggaaggaaataccggagacgcatcagatgattcaagaggcgaaaaacctcgcctatcgggacgtgcagaatcatattttgcgccatgaaaatctttactatcattattttaagatgagacagaaacaatttgaaatcattgaacggctgctgccgaagattacctctatttcaataacggtggagcagggcaaaataatcgcccatttcatccatgaattaagggaagccattcatcccggcaataccgctcataaatttttaaaaagacttgcagaaatgagaacggaatttgaagaaatgccgctcccggcaacgcgcgaggagtttgaagcgcgggcggctttgttccacctcctcggtgagatggaacaatatctcgtgattaaaagttatttcaaaggcatcaagctgtaaaaaacatatggatcaatcgcatgagtcctcctttcattggtcattctaatgaaaaaaggaggggagcccatgcgattttttttattgtcagccgccctgctgctgtctccgctttggccgcttggcgcgaaccctttgccgggtgacccttatattatcgtcaataaagccacaaatgcgcttgctgttgtgaaggataaccgaatacaaggcatttatcaggtggcgacgggaaaaacggatgatttgacgcctgaaggagaatttacggtaacggtcaaagccgtcaatccgtattaccggaagaaaaatgtgaagggaggcgcgccggaaaacccgctcggcgtccgctggatcggttttgacgcgaaaggaaccgacggcaggatatacggcattcacggaacaaacagagaagagctgatcggggggtttgtatcaaacggctgcatccgtatgaaaaaccgggatgtcatccgtattttccggattatccctcccggaacgaaagtattgattacaaaagaaaaccgctcattcgaggaaattgcaatagagcggaaagccctcataaaaaagcaggaaacccccttgcaatgaggcgcctgcttttttaccgcaaatacatcataatgcctgagaggagggttgaaagtataaatacgcccaaaatgacgatgacggcgcttttcataaatttttgagacattgtttcactccttaagattactgtctatcattttaacgtgttttgcttgtatgaacaagccatatcctatggcggaaagcaggtggccgcgctatgaaaaaacttgatcatgtcggcattgccgtcagctctattgaagctgcgagaggattttacgaacggatgctcgggcttacgtatatgggagacgagctggtaagcggccaaaatgtgagagttgcttttttagaagcgggaggcacaaagcttgagctgattgagccgctttcggacgcgtctcccgtcagctcttttttacagaaaagaggcgaagggctgcatcatttagcattccgctgcgccgatatgaaggaaacgatcaaggagcttgaagcatgccgcatgactttgatccatcatgaaccgcaaaacggagcgggcgggaagaagatcgcatttctctctccaaaagaggcgaacggggtcctgattgagctttgtgaaacaattgaaaaaggagaaactcaagatgagcatgagtgatcatatcagacacttaaatgaaagacgttcctttttaacaaacggcggcggagcggaaaaaaatgaaaaacagcacaaaaaaggcaagctgacggcaagagaaagaattgactatttattggacgaagacagtttttcagagctgcagccgtttgccaaaagccgcatgcccggatgccagaatgctccgggagacggcgttgttaccggatacggcacaattgacggacggcccgtgtatttgtttgcccatgactttaccgtactcggcgggacgctcggcgagacacatgcggaaaaaatcgcggcggtaatggatctggcggcgaaaaataaaaccccgatcatcgggctgaacgactcaggtggtgcgagaattcaagagggtgtggtatcattaaatggatacggtcatatctttaggcgcaacgtcctttactcgggagtgattccgcaaatttctgtcatccttgggccgtgtgccggcggtgctgtttattcacccgcattgacggattttgtgattatggcggaacatacgtcgcacatgtttattacaggcccgaaagtcattgaacaggttacgggtgaacagattgacgcggaaagtttaggcggtgcgggaatacataatgtgataagcggaaatgcccactattccgcacgaacggaaaaagaggctctttccgctgtgaaaaccctgctttcttatctcccgcacggcggacagacggcattgcccgttaaaaaggaagacgccagaccgttattaaacaccctcgttcccgcggacagttcgaaaccttacgatgtgttacaggtaataaaagagctggcggatgacggaacgttttttgacattcagccgtattttggcaaaaacattgctgtcggttttctgaaactcggacggcgtacagtcggtgttgtcgcaaaccagccgaaacacttggcggggagcctcacgattgatgccgctgacaaagcgtcgagattcatccgtttttgtgacgcgtttcatattccgctattgacgatcgctgatgttcctgggtttcttccgggccttcagcaggaacatgcgggaatcatccgtcacggagcaaaattgctgtatgcttttgccgaagcgacggtgccgaaagtgacgctcatcatcagaaaagcttacggaggcgcctatgtcgccatgaattcgaaagggctcggggcagatcttgtattcgcctggcccaatgcggaaatcgccgtgatgggagcggaaggcgcggcgtcgattttatacagcagagacatacaggcttctgacgacccggagaaaacgaagcgcgaaaaaaaagccatatacgaaaaggaaaacgccggtccgtataaagcggcggcctgcggaatggtggatgatatcatccggccggaagactcgaggaaaaaattgattcaggcatttgacatgcttgcgcataaggaagaggaaagaccgaaaaaaaagcacggtaatataccgctttaaacggagggaactgaaaatggtaaacgaaaaacgtctgcttgaagaatttcttgaactcgttcaaattgattcagagacaaaacatgaagcggaaatcagcaaggtgctcaaacaaaaattcactgatttaggattgagcgtaaaagaagatgatacaaaagaagtgacggggcatggagccggcaacttaatctgtacgttaaagggcacaaaagatgcggatacgatttatttcacatcgcacatggacacggttgtcccgggcaaaggcgttaagccgattgtggaagacggctatgtaaaatccgacggcacgacgattctcggcgctgatgataagacgggacttgccgcaatgtttgaagccattaaagtgctgaaagaacaaaacatcgagcacggcaccattgaattcattatcacggccggagaagaatcgggattagtcggggcaaaagcaatggatcgttcagacattaccgcgaaatacggttttgcgcttgattcagacggaaaagtcggcaacattattgtagccgcaccgacacaagcgaaagtgagagcaaccattttcgggaaaacggctcatgcgggggtagaaccggaaaaaggcatctccgcgattacaatcgcatcaaaagcaatctctaaaatgccgctcggccgtattgataaagaaacaacggctaatatcggacgtttcgaaggcggcacgcaaaccaatatcgtctgcgaccaggttgatattctggctgaagcgcgttcattagtgcctgaaaaaatggaagcgcaagtgcagaaaatgaaagaagctttcgaatctgctgcagctgagctgggaggccgcgcggaagtggacatcgcggtcatgtatccgggtttcaaatatcaggacggcgatcaggttgtggaagtcgcgaaaaaagcggcggcaaaaatcggccggccgagcgaacttcagacaagcggcggcggaagtgacgcaaacgtcattgccggccacggcattccgacagtcaacctgtcagtaggctatgaacaaatccatacgaaaaatgaaaaaatgccgattgaagagctcgtcaaaacggcggaaatggtcgttgccattatcgaaacagcggccaactaaaaacgaagcacccagttgattgggtgcttttttcattcttcataataattggcttaaagccttgcagatacaagaaaaaaaccctgccggataggttccggcagggtttcagtattatgatttggcgggctccgcctgagccgcagcttgtttctttttatgatgcgtctgctgtaaaagtacattctgcactgtcaaaaatagtccgcttgtaaaccagtaaagcggcagcgcagccggtacgttaagtgaaaaaatggtcatcatgacagggaaaataaagaccatgatttttgctgactgcatcgcggccggattttgagcagccggtgaatatttctcgtttaatttttgggaaatataagcctgtaagaaatacatggcccccgcgcacagtgatacaagaatatcagaatgccctaagctgaaccacagaaatgagtgtgaagcgatttccggcgttgagcggatggcgtaataaaaaccgatcaaaatcgggaattgcaccagcatcggaagacatcccattgccatcggattcagattgtgctcacggtaaagcttcatcatttccatttgcagttctttttgtttctccgcatctttcgtttgtttcattttagcctgaatgctgtcgacctgcggtttgatcacagccattttttcctggaacacccgctgtttcttaaattggttcacaaacaaaggcaatacaacgatccggacgataatcgtcaccagaataatcgacaatccgtactcaccgtggaacaggcccgccacgccttttaaaagtgccgaaaacggctcgatcaggtaatcgtgaaaaaacccgatattcccgaggcctcccgtctgagtctgagatgtcgctgcaaaagccgagcggcctgtgcacagtacgataaaaaacaatccgaatgcgatccatttttgatatgttttagacaattatgtctcctcctttttatcttcacttgccgttataaaaggaggaagctgacatcttcatcatcattcgccggtgaattcatgcggatgactttacgtatccaagttgtaatgcgatgatatataataataagaaagtctgttcggttcagctgaacgactgcttgatgttcatctattcgtttcgttctccaatgctcgcctgcgcggcgctcacgcaaaagaaaagcgatgccgatcgcggtcagagcgggaagaataattgtgaaaaaatcgactaaaaataaaaagtcattcattgactcaagaatcattttatcacatccattcagctcttattttactacatatatataaggttgtctatgaaaggaaaggaggcgccgggagtggccggaaaagggagaattatatttcatatcgatatgaacagtttttatgcctccgtagaaatggcgtatgatccgtctttaagaggaaaacctatcgccgttgccggaaacgtgaaggaacggaaaggaatcatcgtcacctgcagctatgaagcgagagcgcggggcgtaaagaccaccatgccggtgtggcgggcaaaacgcctctgtccggaactcatcatcgtgcctccgaattttgaccgctaccggagttcgtcaaaagaaatgttcagcattctgagggagtatacggatttagtcgagcctgtttctattgatgaaggatacatggatattacggacacaccgcacagccacagggcgtatgagacagccgaagacattcaggcgagactgcaaaaagagcttctgcttccgtcaagcatcggcatcgccccgaataaatttctcgctaaaatggcttctgacatgaaaaaaccgctcggcatcaccattttaagaaaaagagagctgccggacgtattatggcctcttccgattgaagagatgcacggtataggaacgaaaactgcggaaaaaataaaaacgctcggcatcaaaacgatcggtgatttggcaaaaggagatgaacatgcgctgaaaacgcttctcggcataaacggcccgaggctgaaggataaagcgaacggcatccatcctgcagaagtcaatcccgagcggatatatgaatttaaaagcgtcggcaactcatccaccctgtcgcatgattcggctgactgggatgaattaacgggcgtgtttgaccggctcgcgctgtctgtgagcgaacggctccagcgtaaggaggtcatggcctgccggctgttcatcatgattcggtatgcggattggaaaacggtcacaagaagcatgaccctcagcaatccggctgatcagaaagaagacatcatggaagcggcgatggaactgtttgacaagcactggaaccaaaatccggtaaggcttctcggcatcaccggaacggaactggttgaaaaacagcaggcgtataaacagcttgatctgttttcattcaaggaggacgcaaaggatgagccgatttttcagatgatgaacgagctgaatgaaaagtacggccaaaacctgatcagaaaaggcgccgttataaaaaaagaagaaagcaaaacaaggggaacgagctttaacagagactttttccaggatgaaaagaaaaggtgaataacttgaaaaaaggggttatgtatgataatttctttagtataaatatcattttattttaatttaaattttaaaatggttaaacgtttgaagaagggacgttagaatatgtcaaaacaacaaatcggagttatcggtcttgcggtaatgggtaaaaatctggctcttaacatcgaaagccggggattttctgtgtctgtatacaacagatcaagcagcaaaacggaagagtttttagaagaggcaaaaggcaaaaatgttgtcggtacatacagcattgaggagtttgtccagtctcttgaaacaccccgtaaaattttattaatggttaaagcgggaactgcaacggatgcgacgattcaatctcttcttcctcatctggaaaaagacgatattttgattgacggcggaaatacatactataaagatacacagcgccggaacaaagagcttgccgaaagcggcattcactttatcggaacgggtgtatcaggcggtgaagagggagcgctgaaagggccttctattatgccgggcggccaaaaggaagcgcatgaactcgtgaaaccgattttagaagccatttctgctaaagtggacggagaagcttgtacgacatacatcggcccggacggagcggggcactatgtaaaaatggtgcacaacggtatcgaatacggtgacatgcagctgatctctgagtcatatttcattttgaaacaggtgctcggattgtctgccgaagagcttcacgaagtattcgctgagtggaacaaaggagagcttgacagctatctgatcgaaatcacggctgacattttcactaaaaaagatgaagaaacgggcaaaccgcttgttgacgtgatccttgataaagcaggccaaaaaggaacgggtaaatggacaagccaaagcgctcttgacttaggcgtgccgcttccgattatcactgaatctgtttttgcgcgtttcatttccgcaatgaaagaagagcgtgtgaaagcaagcagccttctgtccggaccagacgttaagccggttactgaaaataaagaagagctgattgaagcggtcagaaaagcgctcttcatgagtaaaatctgttcttacgcacaaggcttcgcccaaatgaaagccgcgtctgaagaatataactgggatctgaaatacggtgaaatcgcgatgattttccgcggcggctgtatcatccgcgcggcgttcctgcaaaagatcaaagacgcatatgaccgtgaaccggagcttgacaacctgctgttagacagctacttcaaaaacattgcagaaagctaccaaggcgcccttcgccaagtgatttcacttgccgtagcccaaggcgtgccggtaccttcgttctcaagcgcacttgcgtattacgacagctaccgtacggcagtgcttcctgcaaacttgattcaagcgcagcgtgattacttcggcgcgcatacgtatgaacgcacagataaagaaggcattttccatactgaatggatgaagtaatgaagaagcccccgcagttattgcgggggcttttctgatatcaaaaaccgcggaccgtcatgaacggcgccgcggtttttgatgttttcttatatattccaccagtggagaccgtctttttcaagaagatcgtccgaagctttcggtcccattgacccggcttcataattcggagaaagggttttgtcggctgcccacgtttcggaaatcacatcgacgaaattccatgaaagcgccacttcgtcccaatgggcaaagtttgtcgcatcaccgagcagacagtcatggattaatttttcataggcttccggtgtgttcatttcgtcactgcagttgctgcagtagtccagcttaatcggctgagcatgagcggctccgcctaattttttagcattcagatatagtgtaatgccttcatccggctgaatatggatgacaagcaggttcggatttacattcgtttcattgccgtaataaaggttcatcggaatgtctttaaattgaacgacgattttcgttgatttttctttcatccgtttccctgtgcggatataaaacggaacgccggcccagcggaagttatcgatcaacagctttccggacacgaatgtttccgtattggaatccggtgctacattatgctcatctgtatagcttggtacggagtttccgtcaatcgttcccgcttggtattgtccgcggacgaagtagtcgctcacttcgtttggggcgacagggcggagagctctcagcaccttcactttttcgctgcggatttcttccgtgttcagtttaatcggcggttccatcgccaagagagcgaccatttgtaaaatatggttttgaaccatatcacggagtgcgcctgatttctcataatatctcgcacgatcctcaacgccgagatcctcacttgacgtaatctggatgtttgagatgtagcggttattccacagcggctcaaacagcgcattcgcaaaccggatgacttcgatattttgaaccatttgtttgcctaagtaatggtcgatccggtaaatttgatcttccgtgaaagcttcgcgtatttctttgttaagctctttcgcactcggcaggtcatggccgaacggtttttcaatgacgagacgggaccagccatttgtcgctgtgacaccttcgtttttaagtgattttgcgatcgtgccgaaaaactcaggagccatcgccaagtaaaacattctgttgttcgggatttcatatgtatgttcaagctgatcaagcaggacattcagctcctgataggaacccggattcgttacatcaaacggatggtaataaaaatgagatgtgaaatcgtctatgtctttttgcccggcagaagaaacagacgttttaacggtttcccggaggtcctcgtttgaccaaggtcttcttccaacacctacaactgcaaactcttcaccaatttgaccatttttatataaacggtgaatggatgggtaaagttttcgttttgccaaatcccctgtggcaccaaatattacaattactgcttttggtttgtcgtttgttttcacttagagtacctcactttatctgaagcatggtttaaaaccccgcatatttccttcattttaaatctaaaattcgttgaaagcaaacatttcagcctgttttttgcggtttgcggaaaaaaattaatcaggccggagaaggcccgggtgaattcacattttcagcctgatcctgtatccttagtagtacaaagatctaggaggaagcattgtggaattattatttttagggacgggggccggcatgccggcaaagacgagaaatgtaacgtccgtcgcgctgaagcttcttgaagaaaggcgttccgtatggctgtttgattgcggagaagccactcagcatcagatattacatacaacaatcaaaccgaggaaaattgagaagattttcatcacccaccttcacggcgaccatgtttacgggcttccgggtctgttggggagccgttcatttcagggcggtgaagaagagctgacgatttacgggccaaaaggcattaaagcctttatcgaaacaagcctgaacgtgacggcgactcatctgacgtatcctcttaccgtacatgaaatcgaagaggggacggtttttgaagatgagcaattcattgttaccgcagcatccgtcattcacggcgtggaagcgttcggctaccgggttcaggaaaaggatattcccggcgcattgcaggccggcagattgaaagaaatgaatatcccgcccggacccgtctatcagaaactcaaaaacggcgaaacggtcacacttgacgatggcagaatcattaacgggcgggattttctggaacccccgaaaaaaggaagaatcgtcgctttttccggggatacgagggtatcagagcgggtaacggagctggcgcgcaatgcggatgtgcttgttcatgaagcaacatttgcaaaggaagatgcaaagctcgcacataattattatcacgcgacgacagaacaggctgcgcaaacggcaaaaaaagcaggcgccaaacggctgatcttaactcatatcagcgcaaggtatcagggtgaatcgccgatagagcgtctcgaacatgaggcgaaagcggtatttgaaaacagtaagatcgcatttgacttcatggaggtcactgtggagcggtcttaaaaaatggacgcttgacatttttttctgatgagatataataaaacgtaataattacgatttgaaggggtgaaaatgatgcgtgtgaatgttacattggcctgtacagagacaggggacagaaattatattacgacgaagaacaaacggacgaatccggaccggttagaaatgaaaaagtattcaccccggttgaaaaagtatacgttgcatcgtgagacaaaatagatcacgataacaaaagccattgtgccgttgcacaatggcttttgttttatcagtttaccgcctgataggcaggagcattcatttgctggcgcaccgcgcaccaaacatcataaatggcaaggtggacgatgtgcggttcatcgtgatgaatggcatgagaactgtttttggcctgaatccatccgctttgataagagacatcaagcatgcttctgtgcagtttcacccattgttcatgagcgtgctttaagcgctcatcccgctctcccgatgataaaatcaacagcggcatatcgccgaagtgaatctgctgatgcttgatctgcctaaggctcgtcaaaaattccgcgtgtgatccttccaatttgaactgtttcaaataggcggccttcatttcttcgggaagaagcggaagcactttcgtctcctgatcctcagaaaccggatcaagcagcaccatcccgagaatatcccggcggttccggctcgcccaaagtctgctgataatcgtgccgtatgaatgcgagacgacaaggtaaggaggcttgacgccggccttcagaagaagagcgtttaattcctgtaccatatggtccgccgttctcttgtttcggcttcgtccgcttttgccgattccggctctgtcatatgtgaaaaccccaaattcttcatctatgtcagcgagtaatgatgtccatgtttcagaagaagtgccgtagccggcttcaaagacgatcgtcacttcgccggcgcctttacggtgtttcgtataaaacggacacccgtcaatcagatatgtcctttccatccatgctgctttcattggagtcatcccctctaattggttctatagggaagacggagaagcttcggcaatcgtttctcaaaaaataaaaaaagagacagccggatcgaaaaactccggctgtcacttcatcaccatgctctgtcgtattgaaccggtgacggtatttcagtattcagctgcttcgctgcactccttgcaaagtgcggatcgcgcagaagttctcttgcgacaaaaataaggtcagcgcggttgttttgcagaatttcttccgccattgttcccgtcgttatcaaaccgacggcgcctgttgcgatttcggcctgttcacggattttctctgcgaagctcacttggtagcctgggaagacattaatatcagcttgaacgagtgcgcctgagctgcaatcaatgaggtcgactccctgttctttcatccacttcgcaaaaccgatatgatccgcaatgtccagccctttgtctgtataatccgatgcagaaatacggacaaataacgggccgtcccagacttccttgacagcttcaatggtctcgcctaagaagcggtagcgattttcatgtgagcctccgtattcgtctgtacggtgattggacagaggggacaaaaattcgtgcattaagtagccgtgtgccgcatgaagttcaataatatcaaagccggcttctttcgcgcgcgccgctgcctgtttgaattcctgaatggtttctttaatttgttctgtcgtcatttcagccggtgttttggactgctcatcgaacggaatggctgacggagcgtaaatgtctccctcaagctcagctttacgtccggcgtgcgcaagctgaatgccgattttagatccttgcgctttcacttgttccgtcagtttggcaaaaccttcgatatgatcatcgctccaaatgcccaaatcctgatcggaaatgcgcccctgcggattaacggctgtcgcttccacgataatcaggccgacctgtccgattgcacgcgatatgtagtgcgccatatgaaaaggctgcagttttccgtccttctcatgtgaggaatacatgcacatcggtgccataacaatacggtttttgatcgttacatctttaacggtccatggtgtgaataattttctggccatttatttcgcctcccggaatgtttttagacattgattataacaactcatgatcattcagtcatataaactgctcacaactgaacacatcgttcttattgttctggacgggcatttttttatacacagcgtggccgtatcttcataacaggcatttacagccgatcatatagcaaatatagatgagaaacgcaccgatgactgcgtggcctcctttgaaccagtttgtcaggatgaaaatactgctgatgaagatcactgcgccgaaggcaccgaatattccgtttttttgagcggctctgaaatcgtcggcactcatatttttcagctgcaagtgaatattcagtaacgtcatgatcggcagcaatgtaataacgcctgataaaaataagtatttcgatttggttaaatacgcggcggccaccataacggtgccgccgataaaaaattgaatgagaaaactcatgctgaaacgctcaccttctgtttgtgatcaagtataatgatggaaacattgccattttatttttgattgatgtataagtaaactaaatataactaatgcattggataataaagaatgatatctgggagatgaagccggttggatttaaagaagcatttagcctttattaaaacggttgaaagcggcagcctgacccaagccgctgccatattgaattacacacagccgaacatcagccaaatgatcagtaaattagaggaagagtacggttttccgcttttgatcagacagcggcatggagtgaggcccaccgcaaatggcttgaaagtgttacatattatgaaggaaattcaaaaaaactatgaaaaactgtctcaaaccgttgataatattaatgggttagaaagaggggaagtccggctcggcactgttacgagcgtggcggtaaaatggctgccgaaaattttgagggaatttaatgagctgtatccttccattaaggtgcatttgtttgaaggaaattctactgaactggaagaatggttgaaagatgaccggattgatgcggcgatcgggacatcccacagcgagaagtggcatttttacccgttggccgaggatccgattgtagcggtgatgagcccgcagcatgaattggcgcaatgtgaaacggttccgttacatgtcatggagtccgtcaaatgtatcgtgccttatccggagacacattttgatgtgctgaaagtgctgaaggaagaaaagatcacaccgcgggtcgcttatcaaatcagaggggatgaagcgattattgcaatggtgcggaacaatctggggatcagcatcttgccgcagcttttggtgaatgattgtgatgtgctcatcaaacggtttgaccggtatgtcttcaggcagctcggcattttgacagctcatgcaaaggagacgcagacaccttctgtccagaaactgattcaatgcatacaagaatgggttgcggtccgtcaggcttctgtctgaagaagcctgatgaaccgtttaagccggttcagcataatagaacagcataaaatatgtcaccggttcatccgaggaattaaaataactgtgcggcatcgcccgaagtcagcacatgcttttcgtcatcaagctcaaccgtcaattcaccgctcttgattaaaatgtatcttcccctaaatgtgattttgcctcatgggcgcagcccggcttcaggtcaactatgtcaaaaagtttgaccgtgacggtggtgagcggggttatttcggtgtcgggctttcgtttgtatataaaaagggcatcaacggcacatgctgttgatgctttttttgaaatgctagggtttggagagcacttcaattccgacgttgaccattttgtccagtcccataaaagacaggcagattttggcgcgtctttttcttttatcgatctttttaataatgccttccattcctttaagaggccctgaggcaacggttacttttgaattttcaatatagacttttgaataatctacagtgtctccttctccgatcagcctaatgatagggaggatttcttcatccttaattgtcgtgaaataggttttacgctctttggaataatatgcgccgttattcacgattctgcatgaaatggggagttctttgattttatgaaatgtccgctctgtcatcttcgttttaaacaacacatatcccggaaacatctttttgagtgcctcgtatttgattccggcttttcgttctgtgacttttttcttgggtatgattgagtagagagcctgctcatcaaactgcagacgcagaaatttttgaactgtttcttcttttccggactctacaaaaagtgcgtaccatttcatgactgggtcctccttagaataataagaaattattatacaaagaaagtatttaatggatagtatttaaagtgattaaaaatttttctaattcgtcttttttttacataatatatgaaaatgaaaaataagtatagacccaattgacagagaagcgatgaattttctttgacatgaatagggttcagggaattatctgacatttatcccgaaacaattatgccgactgtccacctaacataaaactgtggaataaatgtcagaaaataacgaaataaagccttgacattattatctataaattgatattattctctttaaatagcaactatttgttaaatttattaaattgatgtaaagcacctattaaatttcaatcgctgtttcggcacgttgaagaggaaatagggattataaaaatgattgtagtgtatatatctacatatacatgataagggagaagtgtgccgtcatggctgttttcgggcatattggcactgcagcttgtcatgcgaaacattcagtaaacaagcaagatgtctttatataaattatgttagaaaaggaaaacacaatgcgtttgcgatttttaaacctgtgctgaatcgcaaacgcgtttgtgtttttatttttatgccggtgtttacaccagtcaatatatgaaataagagacgtttttgtatggagatccacatgtgatgtacaaaattggcgatgcggaaaggatgaggataagatgcttacgtttgtgttcccggggcagggttctcaatttaaaggaatgggagccggactgtttgatgaatttcaagatctgacacgtcaggctgatgacatattaggctactctatagaagaattgtgtctggaggatccgaatcaccagctggggaaaacgcaatttacccagccggcgttatatacggtgagtgcactcagttatttaaagaaaaggaaagagtccggcagagagcctgattacgccgcagggcacagtttaggagaatataatgcgttatttgcggccggctgctttgattttgagaccggtttgcagcttgtgaaaaaaagaggggagctcatgagcaaggcagctcccggaggcatggcggcggttttggggtttaccgctgaacaagtaaaagaggttctatccgattatcatctgaccggcattgatatcgctaaccacaattcaccttcgcaaattgtgatcgccggaacgaaacaagacattgaaaaagcgggccccgtctttgaaaaagccggcgtgagaatgtaccttcctttaaatgtgagcggcgccttccattcccgctatatgaaagatgctgaaaaagagttcgcggattatttagaagaaacggcgtttttgcctcttcgttttccggtgatctcaaatcttcatgccgcaccttataagaatgatgaaatcaaaacaaatctgactttgcaaatgaccaatcaggtaaagtggacggacacgatacgccgtctgatgggacttgaaaataatgaaattgcagaagtcgggcccggggaagtgctgacaaaactgacgagtcagattaaaaaagatgccgtcccattacctatgccgaaagaagagtctgatactgctgatgttaaagcatcggcagctgatccgcaaaaaacggcgggaatgagattagggaacgaagattttaaaaaagattataacatccaatatgcttacatgacgggctccatgtacaggggaattgcttcggaacagatggtcattaaagcggcaaaagcgggaatgctgggctttttcggaacgggcggattgagtatcgaacggatcggacaggccatcggcaccatccggtctgcactgcggcaaggggaaacattcggaatgaatcttcttcatcatatgatgtcacctgacaaggaagtcagaatgatagatttatatttgaaaaacggcattcatcttattgaagcatcggcatttatgggcataacccccgctcttgttatatacagggcaaagggattaagcaggaatcatgacgggtcggtgtcagttcaaaacaaaatcatcgcgaaagtatcccggcctgaagtcgctgaggcctttctgaatccggctccggctcatgtgctggaaagacttgtgtctgacaatcggctgacagccggggaagcggcgcttgcaaaagaaattccgatggctgatgacatttgcgttgaagcggattcaggagggcataccgaccaagggattccgtatacattaatgcctgccatgatcagactcagagaccgcatgatggagaagcacggttatgcgaaaaaagtaagaatcggcgcagcgggcggcatcggcactccggaagcggctgctgccgcgtttctgctcggtgccgaatttatcggaaccggttctattaatcaatgcacggtcgaagccgggacaagtgattcagtgaaagatctgcttcaggaagcgaacgtgcaggatacgtcatacgctcccgcgggagatatgtttgaagcgggagcaagggtgcaggtgctgaaaaaaggcctgtttttcccggcaagagccaataaactctttgacttgtacagacaatacaattctttagatgaaatagatgaaaaaacgaaaacattaattgaagaaaagtatttccagcgcagttttgaagaagtgtatgagcagttgaaacgtgataaatctcctgagcagatcgccaaagccgaacagaatccgaaacacaaaatggcgatggtatttaaatggtatttttctcatacgacaaggctcgctctggaaggaaaaagcgaaagtaaaatagattaccaaattcattgcggccctgcgctcggcgcgtttaatcaatgggtgaaaggaaccccgcttgaaaattggagaaacaggcatgtcgatctgatcggcaaacagctcatggaagaaacagccggccttcttgcgcaaaggctggtatcgattacaggctgagtatgaccagacattacattttttctgcggaggacagaccatgctgattgaaaatcatgaattaacgatgagccatgtcgggttagggaatttgaatgagtacgcgctgctgctgttattcggcaacgcacacagtcaccatttaacggacggaacaggattccggcctgatcagatggccgatcaccaagggctgattttgtatccggcttattttatgacacatctcaaagttccttcagatcagcctcttgatcagtaccgattatgggacgaggtttccgtcggagtcgatatctcccggtttggagaaaccatattagaatctgattatttgttcgggccgaaaggagcggtcagctctgataaaagcgagtgggaccggggacggtttccttctatgaaagccaatagtttaattgtcgtcgacgtcacacaaacagaaggttcgacgcgcaaagtctcagcgcctaaggctgaatgcattgcggaactttctaagctagccaagccgccttacgcgctgatgcggtcaaagaaaatcagaacggacgccttcggtatgaagccgggcaatctcaaaacagcagaccccgttttatatcgggttcctattgatcaggatgctgcgcccgggcatgccatggtgtttgcgaaattcagcaagataatggatacggcggaatttgaatggatgacgcgccggtcgaagccgggttttccggtttcaatcgcgcggcatttatttttgcttgaaagagagacgtattattacggaaattgttttgcagatgaagagcttgatatttatatgacgggacacattgaagaatgcgatcccgactttcacggtgagtccctcggtatgatctcagtggcgaaaatcagctatcagattgaagtctatatgaaaagaaatcatacattgctggccatttccaaggtggacaagctgctggcggtgccgacctcttcacaagatcatattccggattataagcgggtcatcagaagtttataaaatgaagaatggagctgaaagcaaatggaacaaaccaaggaaatgaagcagatcatcgcacaaatcattcaggacattcaagaacagcagtcatatcgggccgtcgaagcgggggatgatgtgagagtcatagaggatctgggcttctcatcactggatatcgctcaattagtcgcacagatggagatggaaaccggagtagatcctttttcccaaggagaaacgatttccagcattacaaccgtcggcagcatttgtgatatttatcaaaaatatatggacagtgctcaatcatgaaaacagaaagcgggggagatatcagctgggtgactgataagcttagggaaacgcaagacagtgagtttctcatttttaaagggcagacttttacgtatgatgatttgctgacacgaatcagcttttttcagaaagaacttgaacaaaacggaatacgtgaaggagaatgtgtggcgcttatcggggattattccccgaacgccatttttttgctgatggcgcttttgttaaaccgaaatatcgttgtccctctcagcaatgaatcaagggaaaagcatctcgatatgtttgaagacgcgaaagtgaatcaaatcattgaaataaatgaaaatgacagctggacgcttcgtgcaggttctgaaagcgcctctcaccctctgcttgatgacctgcgcgagagaggggagtcaggcattattattttcacatcgggaacttccggcaaaagcaaagcatccgtgttaagcgccggccggctgcttgaaaaatataaaacggcgaagagaaaaccgctgcgtacgctcatttttctgaaattggatcatatcggcggcattaatacgctgtttgcgattctgtttaacggggggaccatcgtcacatcagacagcagaacgccggagtccgtttatcaggcggtcgacaagcatgctgtccaagtgctccccgccaccccgacctttttaaacatgctgctgatgtccaaggcggatgccggctataacctctcttcactccggctgatcacttacggcacagaaccgatgccccaatcaacgctgcgcggcattcaccggctgtttccggatgtacggctgaaacaaacatatggattaactgaactgggtatattctcaacgaaatcaaaagacagccaatccacttggatgaaagtgggcggtgccggaacagagaccaaaattaccggaggcacgctttgggtccgttctgagtcggcgatgctcggctatttaaacgcaccgtcacctttcgatgaagacggctggtatgacaccggtgaccaggtggaaacagacggcgaatatataagaatccttggaagaaagagtgaaatcattaatgtgggcggagagaaagtgtttccggcagaggtggaaagcgtctttctggagataccgaatgtccgggatgttctcataacgggaagaaaaaatccgattacgggcgagattgttgcggcagaggccgtgcttgaaaaagaggaagatatcaaatctttcagaaagcgggccgtagctcattgcaaacagaagctgcagccatatcagataccgcagatcatctctgttacagatcggaaactgtctaatgaccgatttaaaaaaataagaaacgtgtaaaacaggaggcaaatatgaataacggaaaagtagcggtcgtcagcggaggaagccgggggctcggaaaagcgattgtacagacgcttttggatgaggattacaaagtagccgctttcagccgcagtgaatctgattttattaacacattgagagagagtgaaaagtaccgcggccgcttttattgggaagcggcggatgcggcggatgatgccgccatgaaacagtttgttcttcaagtataccgcaagttttccagaatagacggcttggtcaataacgccggtttgaaccttgatcagctgctgcccctgaccaatgatgaagacattgaccgcatcctcaatctgaatatcggctcagtcatcaagctgacccgaaacgtatcccgtgtcatgctgaaacaaaattccggatcaatcgttaacataagctccattatcggctcaagaggatttaaaggcacttcagtttacagcgcatccaaagcggctcttgacggcttgacgcgaagcctggccagggagctcgggtctaaaggaatccgtgtcaattcacttgcgcccggttttgtggacaccgatatgacgaaaaatatgccggaaaaacaaaaatcgcagattatcagaaggacgccgatggggcgtttaggcgaaacagacgatatgaccggactcgttcgtttcctgctttctcctgaatcgtcctttatgaccggacagacaatggcaatagacggcggattaacttgttaaagcacagaaaaattcttttgtacaagggatggtatcctcatgaaatgtattaacgaatttttaagaacggtaatagcgcaaaagctgggtgccgaggtgaccgaagcggaagataaaaccgctttttttactcttggcgtgacgtctctcatcagtgaagaaatcatgaccatattgcataaagaatttaccggcctttctgaaacgctgctgtttgaatatccgaacattgagaaattgagtgagtttttaagtgcgcagaaacgaaatcccgaaagcgttcttgaattcaaagaaacggagcctgatacgggaagccggcaggaagaagaattgcttcccgtacaggcggctgaaaaggtgcctgtacaggaaacggacgggagctctgatattgcggttatcggaatgagcgggatgtttccgaaagcggaaaaccagcatgatttttggaacaatttaatggaaaataaagattgtgtcactgaaatcccagaggacagatgggacagctcttattactcggaagagaaaacggcagaatacgcgtcatacagtaaatggggaggttttattgatcatccggatcaatttgacccgctgtttttttctgtttccccgtgggaagctgatttaatggaccctcagcaaaaattgtatgtcacgtgctgctgggaagcgatggaggatgccggttacgggaatccggcggcgaggccgacggatcaaatcggtgtattcgccggagtgacctggaatgaatattcattaattgcacacgaagaaggtttcctcaaagatcagtacaaaggccccggctccttatattggggcattccgaaccgggtttcttatttccttgatctccatggcccgagcatcgctgttgatacggcgtgttcttcatcgcttgtcgccgtccatcaggcttgtcaggccattatgtcgggcgactgtgaaatggcgcttgccggaggcgtcaacctcagcttacatccgcaaaaatacatgtttttaagccaatcgcattttctgtcttctgaaggaaaatgccgcagtttcggtgaaggcggagacggttacgtgcccggtgaaggtgcgggagccgttttgttaaaaccattgaaaaaagcgattgcggacaacgaccacatctacggtgtcattaaggggtccgccactaatcacggcggcaaaacgaccgggtatacggtgccgaatccggaagcgcaccgggacctgattttatccgctctaaacagagccgcggtaagtccggcggatatcagctacattgaagctcacggaaccggcacggcactcggcgatccgattgagatacgcggcctgtctatggcatttgataaacagaccgatgagaaaaactactgcggaatcggctcggtgaaatccaatatcggacatttggaagcggctgcagggatcgccggtttaatcaaggtgcttttaagcatgaaacatgaaacgcttcccgccagtctgcactccgaggaactgaaccgcaagatttctttttctgattcgccattttatgtcgtccgaaacaaccggccgtggccggctgaaggaaataaaccgagaatcgccgcaatcagttcattcggcgcaggaggctctaatgcccatctgatcgtaggtgcttatcagccaaaacggcaagcggacgggaatactgagcaaaaaccgcatgccgtcgtattaagcgcacattccgaacagcagctgaaagaatatgccgggaaattaagctcttttcttgcccgattggaaaacctgccttctgccggcggatacagtctggaaaatatcgctgccaccttattgtcaggcagagagcctttctccttccggcttgctgtcattgcatcatccctttctgagctgaaacagcgattggacggatttgtaagcggtcacagcgacggcaggcatatgtacttcggaaaagcgtcacccgggcggccggacgtttcaggccaatccgtttcagatcctgagaaatttgccgcgctgtgggtgaaaggccttcagtgttgcaaaaagccggaaacgccgtatcagaaagtcccgcttcctacgtatccgtttttaaaggaaacgtcctggctgaccgatcaaaaaaagcggtatacaaaaaagccccaaaatatcaaaaggcgtgaagcgctgcatcctctgcttgatgagaatatttcatccgcccggaaagggacgtttcaaaagatattttccaaggatgaatatttctttaaagatcatttagtgaacgaaaaatatgtgcttcccggagtctgtcatctggaaatggcggcatacggcgcgggattgtggggagaacgcccggtcgtctctcttcaaagtgtgtggtacatggagccgattgtgacagggacagacccaagatccgtcatgatagagtttgaagcagaaaaagagcgtataagctatgtcattaaagaaaaaggagcggacggcaccctcttttcgcaaggagaagtgatttgtaaagaaaaaggagcgtcttttgaggccccggcctttcagctcccggcgccatttgcgcagagaacggagccagaagacatctatcactcgttctctgaggcgggaatcgtgcaaaaggacagttttcaggtcatccgcgaattctcttatacagaaaggaaagcactggccaaattaacgctcccgtcacacttggaagccgattttaaacagtacatcctacatccgtccttaatggatggcgctgttcaaactgcaatggcgcatgtgctgcaatttcaaaaagagcctgtgcttatcgtaccgttttccttcggagaaatacagctgcttgaaccgttagcgaaaaccgtatttgtgcatgcggaggtaaaagcggcctctgttcaccaatttgatctgcatatttgtgatgagcgcggcgtgctgttggcggcagtgaaagattttatcataaaagaggtgcaggaaagcgccgggtttaaccaaaaagccggcgtcacgccgaagaaaagctgtgaaacggaattgcttatgacaccggtttggaacaccgtcaccattccggaaaccggcatgtctttcatgcgtgaagaaaaaataatcgtcatcggggccgggccggattttcagcaggctttgaaagagatgtattccgatgtccgttttccggacatcacttctttggatagcgcggaacaaatggctgaaacattgaaagcgcaaggctcttttcaacacatgatatgggcggcgccggatcatcccattccatccgtttatgatgcggatacggccgagggacaggagcacggggtcatgcagcttttccggctggtaaaagcgcttctgcttctgaattttgacacggaacaactatcattgacaatctgcacgtttcaagcacagccgattcatgaacatgatgaggtcaatccgagtcatgcaagcatacacggattagcggggtcgctcgcaaaagaatacagcaattggagcatccggcttcttgatttggaatctcaaaggggagaccggcatctccccgatgtcttctctttaccggcggactccgagggaaatccgtgggtctttcgtgcaggtcagtggcaccgacagcaattggccgtctgccagcctcatgcagatgagccttcattataccggcacggcggggtttatgtgattatcggcggagcaggcggaataggagaagtatggactgaatatatgattcagacctatcaggcgaaaattatctggatcgggagacggaaaaaagatacacagattgaaagaaagctgaaaagacttgcggctttaggccccgcaccgcaatatttcagcgcggatgctgccgattatgactctctcaaacgggcgtatgacaccattgtaaaggaaaatggaaaggtccgcggaatcatccattccgccatcgtgttatcagaccgcagttttgccaatatggaagaggatcagttccgcgcgtcactttctgcaaaaactgatgtgagcttgcagattgcccgggtagctgaaggggaacccctggatttcttgctgtttttctcttcgatgatgtcgtttcaaaaagcgccgggacagagcaattatgccgccgggtgcacgtttaaagacgcttttgctaagcggatctcacagaaagcgccgtatgccgtaaaagttgtcaattggggcttttggggaagtgtcggcgttgtcgcttcagaacaataccggaaacggatggagcgggacggaatcgcttctattgaggcgcccgaagcgatgaaaacgctggaaaccctgctttccggacctcatgaccagctggcgctgatcaaaacgacagatccggtttttatgaaagacgatctgaaagaacaagtaacggtttatccggaaaagattccttccgcactcggacaattagcggttaacatcacgcagaatgacgaagctgagcggttaaaagcatcaagtgtcatgagctgcatgagagagatggaatcccttattgaaaaaatgcttgcatcaaccctttatgagatgggagccgggcttgatcaggctttgccgttatttcaatcggctgccggcataacggaacaatacagcagatggctgaaagagagctttgtcctcttgactgaattagcgcttgctccggaaaaaacggatctagggcaggtgtgggaggaatgggagcggaaaaaagagacttggctgcgccagaaagacatgagggcgcatgtcagattggcagaagagacattgcgtgtgcttccagacattttaaccggaaagcttccggcaacggaagtgatgttccctgactcctccttccgtcttgtggaaggcatttaccgcaataatatcatttctgattttttcaatgacaagcttgctgacacattgattgcagttttgaaggaacgtctggaaaaagacccgcaggcgaaaatccgcattttagaaatcggagccggaacaggcgggacgagcgccgcggtcatgagaaaattgaaaccgtatgaagcgcatattgccgaatattgtttcacggatatttctaaagcatttcttttacatgcagaagacatattcggtccggaatatccttatgtcacttataaaatattcaacgctgagcagccggtatcaacagaagcgccggacatcggcacgtatgacgcagtgatcgcgaccaatgtgcttcatgcgacaaaaaatatccgctctacgctgcgccatgcgaaagcaatgctgcaaaaaaacggccagctgttaataaatgagatcaacagccgcaccatattcaaccatgtgacgttcggccttcttgaaggctggtggctgtatgaggatcatgatttacggattccgggctgtccgggggttgatccggccggctgggcggaagcgctttcgcttgaaggattcgtccatcctctgtttccggctgaaaccgcacacgacttaggccagcagattatagcggctgaaagtgacggaacggtcaggcttgccctcacgcaggcgtcagaagagaagccggagcgccgtccgtatgacgcagaaggtctttcggatgatactttgcacttcagcctgagagaaaaaagcgttgaactgatgaagaaggtaatcggtgaagcgcttaaagtgccggcgcatcgtcttttatcccatgaacctttaaccgcatacggattggattccatactggtcgtcagactgaccaacgcgttaaaagacgtcttcggttctgtcagcagcactttattttttgaatatcaaaccattgatgagcttgctgattactttctgtcttcccgtaaagaagcgctcgagcggcaattcgggaatggacgggctcatcccgaaaacgccggacgggtgcaggctcccgcagaaagcgccgcgccgattccaaacgtaagagaacggggcatcgcatatctgacggaattaataggaaaaacgttgaagattccgagcgggagaatggatccgtcggtttccttaaccgcatacggtttggattctattctggtcgtcaggctcacaaatgcctttcgtaacgtgtttgaccaaatgaccagcaccctcttttttgaatatcagacgatagaagaaatcgcggattacctgcttctttctcagccggaagcatttatgaaagcgatgggtgtgcgtgaggcacagctggctgatcacacagataatctgaatgtaaaacaaaacaagattcctcaaaacgaggaaggcagcaggacgaacggagatccctatatccaggatatcgctgtcatcggtctgtcaggccggtatccgggcgccgatcacgttgatgagctgtgggaaaatgtaaaagccggcaggcattctattactgaagtgccgaaagatcgctgggactggaaaacgttttataacgaggaacgcggaaaatgggggtccatttattcaaaatggggcggttttctcgatgacattgataaatttgatccgctgtttttccgtatatctcccgcggaagctgaaaggatggatccgcaggaaaggttgtttctgcagactgcttattcaagcattgaagatgcggggtacaccccggccacgctttgtgacagccggaaaatcggagtctttgtcggtgtgatgaacagcaattacccgacagttcccagcgactggtctatcgcaaacagagtatcgtttttgttcaatttccaagggccgagtatggctgtggatacagcctgctcttcttctttaacagctgtccatctcgccgcagaaagcctgcggagcggaatgagtgaaacagcgattgccggcggagtcaatcttatcgttgatccggcccactatgagcggctgtccgctttttcaatgctgtctcccggtgataaatgcaaatctttcggagacagtgcggacggttttgttgacggtgaaggagtaggggcgattgtgttaaagccgcttgctcaagcggagaaagacggcgatcatatttacggcgttatcaaaggaagcatgctgaacgcagcaggcaggacaaacgcttatatggtgccaaatccgaaagcgcagtttgatctgatcgcagagacgttgaaacggacagacattcacccgagaacggtcagttacttggaagcccacggaacgggcactgcgctcggtgatccgattgaaatcgacgggttaacgaaagcttttcgcctgacaacagaagaccggcagttttgttccatcggttccattaaatcaaatatcggacatttagaaagcgctgccgggattgcggggatcaccaaactgcttctgcaattgaaacataagaggattgccccttcattgcatgcggcggaattgaatccgaatattgagtttgagcacactccgtttttcgtacagcaaaaagaaacggaatggaaacgacctgtcttgaatatcacgggtaaaatgaaggaatatccgagaattgccggcatttcctcgtttggagcaggaggttcaaacgcacatgtcatcattcaggaatatgtgccgtctgacagcctgaaaccaatggaaaacgcgtctgtttctccgcaaaaaccggctgttatcattttatcagcgcgaaatgagcagcaattatcagagcgcgcccgccagcttctggatgatgtcataagaaaaaaacgttctgacggggatttggccaagatcgcttacacgcttcaggcgggaagagaaccgatggctgagcggcttgcatttacggccgagtcgatagaagaactgaaaatgaagcttatgagtttctcaaacgatcataatatcgaacatgctcatatctggcggggcaggacagccaaacatcattcattggcggcttcgctcacttctgatgaagatatggcgcttaccataaatgcctggctgagaaaagggaaatacggaaagctgcttgacctttgggttaaaggacttgacgtcgattggtcagctctttatcagtgcaacccgggccgcatcagtctcccggcctacccttttgccaaagaccgatattgggtcacaaaagctgatgtgtcacttgacaaaacaggctcagcgaaaagtgagaaagcagccagacttcacccgctgctccacgcgaatacatcgacctttaccgcccagcgttttacttctgttttttcaggacatgaaccgttttttgccgatcacatcgtcaatggaaaaccggtgcttccgggcgcggctgctttagaaatggcccgggccgccgttacatttgccgccgaagacttgccgggcgggaaaacgggtgtaaggctcaaacagatcgtttggctccgtccggtgacggcgctttctgaaggagtgacgcttcatgtaaagcttcagccggaagaaaacggagacatcgcttttgaagcgtatgccgaaggagaagagccgcttgtctttttccagggaaaggccgtgctcgaagagacggagcgtgctcctgttctcgatgtagaagcggttcaggcgcgctgcggcggccgtcacttgtcaaaggctgagtgctatgaagcgttcgacagcctcggcatcacctacggaccgtctcatcaggcgcttgacgccgtctatgccggaagcggagaagtgctcgcaaagctcactcttccgccgtccgcccgcgaagaaaaggagccgttcatcctgcatccgagcatgctggacgccgcccttcaggcttctatcggtctcgtgctctcagacggttccgcgtctggacggccgtttctgccgtttgccctccaggatatgcaggtgttttctgcgtgccgggagacgatgtgggcggtgctttcctcagcggacggcgcctatcatattgagctgtgtgatgaaaacggtgcggtatgtgtccgattgacggggctcaccgcccgttttctggaagaggaaacggaggaaaaaccgctcttgcttcagccaaagtggcaggaatcaccgccggatgaaggcggcggacaagaagagtctttcagatacgtgacactgtatggcggaatgaacgctgaggacataagcggcgccgtatgtgcggctgacggcgaaggtccgattgaagaccgttatgacgcctgcgcggcggagctgtcagcgatcgtcacgcgtcttatcaaagaaaaacagaagaaaaaaacgctgatccagcttcttgtccccgacaggggggaagacaatgtattggcggggctggccgcttttctgaaaacggctcaccttgaacatccgaagctgtacggccaagtcatccaagccgatccggacgagtcagcctcggcgcttcttgccaagctgaaagaaaaccgggcgcatcctgaacaagcggaaatccgttatgaagccggcaaacgtctcgtcagaaactggcgtcatctgccggcgcctcaaagcggcgccgttccgtggaaagacgaaggggtctacctccttaccgggggagcgggcggcatcggcctcattgtcgctgaagaaatagccttccgcgtcaaaaacgccgttctcgtattaacgggaagggcggaagcgcttgataaagaccgctccgcccgcttacggcgcttggcagcgacgggtgcccgcgtattgtatcaaccggttgacgtgacagacagggcggcggtcatcaccctcgtccgcggcatacaggaggagcacggaacactcgacgggatcattcacggcgccggcgtgatcgctgacaattacattctgaaccagacagaaaacgaacggaagaccgtcatggcgccgaaggtgaaagggcttatcaatcttgatgaagcagcgaaagatgtgcggctggactttttcattctgttttcttccttggctggaggtatgggaaatccggggcaggccggttatgcggcagccaacgcatttatggatgtttatgcagcccgccggaaccgtctcgtgcgggacaacgagcggagcgggcagaccctgtccgtcaactggccgctttgggaagaaggcggtatgcgtgtggacaaagagaccgaacggctgatgtacgaacagaccggaatgaaagccatgcgatcggcctcaggcatccaagcgctttacgccgcttttgcctccggagaacaccaggtcatggtggcagaaggcgacgaaaaacggattcgaaaaaacctgatgcctgaaacaccggaaccgtccaatcgcattcatgtgtcaaggaagacgcccgtccatataccgaataaagtacaagcggaactcaaacatatgatatcaggcattctgaaggtgaaagaagacgagatagatgctgaatcagagatgagagattatggctttgattcggtttcattcacgcagtttgcaaatgaactaaataaaacgtatgggcttgaactgacaccggccgtattttttgaatacccgacagtctttcgttttgcccaatacttgctgacggaacatccggatacattcggctcacaggaagaaacagaaacggagaaaccggttgtgcgtaaaaaaatgaagacggagccattcttgattccgtcccgtcttcctaaaacaaaaaccgcagctgcacctgagcccgtggcgataatcggaatcagctgtgcatttccaatggctgaaaatccggaaatgttttgggagaatttagccggagaaaaggactgcatttctgaaataccgccggagcgctgggactggagacagtattacggagatccgcagaaagataaaaatgcgagcaatgtaaagtggggcggcttcattgatgaaaccgctcaatttgaccctttatttttcggtatttctccgcatgaagccgaaatgatggatcctcagcaaagacttttaatgatgcatgtatggaaagcgattgaagatgcaggctgctctgccaaaagcctgtcaggtacaaatacaggcatttttgcaggcacgacaaacagcggttacgctcaggaagcttcaaagttccatatagagattgagggttcttccgccgccggtacggttccgtcaatcggtccgaaccgtatgagctattttctgaatatacatgggccgagcgaaccgattgaaaccgcctgttcaagctcattggtcgctgttcaccgtgcggtcagggcaattcaggccggagactgcggcatcgcgattgcaggaggcgtcaatgctattgtatcgccggatatgcatatcagctttaataaagcgggaatgctcagtgaagacgggcgatgcaaaacattttccgatcaagcggacgggtatgtcagagctgaaggtgcgggcatgattgttttgaaaacattatccgatgcggaacgtgacggcgaccgtatttatgccgttattcgcggaacggcggaaaatcatggcggacgggcggcttcccttacatcgccgaatccgaaagcacagacagaagtcatgataaaagcttatcagcaagcgaacatcgacccccgtacagtgagttatattgaagcccacggcacgggaacggcgctcggagatccgatagaaatcaacggactcaaagcggcttttgcagcgctttatcagaaagccggagtaacggcgcccgatcagcctcattgcgccatcggttccgtcaaaacgaatatcggccacacagagcttgccgccggcatggccgggcttttaaaaattattttgcagatgcagcacaaaacgctcgttaaaagtctgcattgtgaaaccgttaatccgtatatcagcctcgacggcagcccgttttatttcgtccgccacactcagccgtggaaagctgcgactgatgatagcggaaatgaactgccgcggagagcgggtgtcagctcgttcggatttggcggtgtcaatgctcatgtcgtgctcgaagaatatgtttctcctgttgaagagaagcaatggacggccggtgaacttcagccgtccttattcattctctcggcaaagacggcggaacagctgaaggaacgtgcggaacagctgtgcagatatttggaaaagacacattcagctgacggagctcttgcgggtatcgcttatacgcttcagcttggccgggatgaaatggaagagcgtcttgccgtcattgctgaaacaaaagaagagcttacgaacgcgctgaatgatttcctcagcggcaaggagacggggcagaatttctttacaggccggaacaaagcgatgaaacagctgtttacagagatgacggacaacgcagaaatgagcgggaccgtagatcaatggattgaagcaggaaagtatacaatgcttgcaaaattatgggtgcaaggtttacatgtcgactggaataaattatatccggacgaaaggccaaaaaaagtcagcctgcccgtctatccttttgcgaaaacacattgctggataccgcacagtgcgcagcatataaggcaccgggagacttatgagactgatacgtccccgcttgagacttatgagcgcctgcttgatgatttggagaaaaacgaaataagcatagaaaccgctgtaaaaagaacgatcggtttttacagggattagcgtaatggaggaaaccatatgaaagagtttctgcaccgggttttttctgacgtcaaaaataaaaaaatgacaaaacaggatgcgatcggcattttgcgcgattatgatatgcggatgggacttcgccaagcggcttcccttcatccgcttgctcagcagcatatttccgatgaaacgggacagggattctcggcagctttcagcggccgggaattttttctcgctgatgtttctttacagcgtaaaaagcttatgcccggagaacttcttttggaaatggcgagagctgcggctgttttgacagtaaaggagactgaggctgtccggctgacgcatatcgtgtggtcaaagcccattctgactgaggctgagccgttccatatcgaaatcaggctgatacccgcagagggtgaagccaaaaggtttgagatttataatccattttctgccgatttcagtcatcatgatgtgtacagccaagggacgattcagccagttgatgctgcgcctggcatgctggatatcagccgcttgaaggaaaacagcggttccctgatggatcagcagcaaattgaagccatcactcagaacgataccgttcaatacagtgagcacatgaaaggaatagagcgtatttacgcctcagcaggacggatgctggcagacatatcaattccattgacagaccaaaaagaatccgcacgattcggcctccctccctgtgtgatgcaaagtgtgacagaggcatgcgcgctgcttggcggcaaagaatataaaacgctcgccccggtttcattggacgagcttttgttttatgaaccttgtcctgacaagggatgggccgagatacaagagaaggcggggagcttttatattgatttatgtgacgaagaaggaaaaatatgggcttccctatcagggttgaagctgcagcctgtcatcaagacgggcgctcccggaaaaaccaatgccgaacaccgcagtgaacgtttgtatgaacaaacgcttcttcagctcaaaacgctgtttgccctgactacaaaaattgctgtttccaacatagacactgaagagccgctggaaacctacggaatcgactcagttactgtgacgaaattgaaccgcgaattgtctctgcttttcggtgacctttccaaaacggttttttacgaatataagacactgggctccctggcagctcactttgtcacggattatccaaaagaatgccgaaaatggacaaatgatgatgaccaccgttcaggcatatcagaacaggttttggcaaatgaagattttccggtgcttccgtcgtttatcaagcgaaagaaacggccttctttttccaatgagaaccagacaaaagaagggattgcgattatcggagtcagcggacgttatccgcaagctgaaacacttgaagagtactggaataacttagcggccggaaaagactgtgtgacggaaattcccgaagagcgctgggcaaaggacaagtactacaaccctgatcctgaagcggccgtgaaagaagggaaaagttacagtaagcggggcggaattctgaaagatgccgctttctttgatccgctgttttttcaaatttcaccccgtgatgctttgaatatggacccgcaggagcgtctctttattgaaatgtgctggcaggtgctggaggatgccggttatacgaaggaacagcttgagaatctgtataacggccgggtcggcgtttttgcgggcattacgaaaaacgggtacggaatgtactggaaaaacggcggcgccctgcagccgaaaacgtcgttcagttcagcggccaacagagtttcctattttcttaatctgaaagggccgagcatgccggtcgacacgatgtgctcatcttcgctgactgcaattcacgaagcgtgtgaaaacatccttcgcggcgaatgcgacatggcgattgccggcggtgtgaatgtgtatacgcatccttcggcttatgcggagctcagcgcctatcgaatgctttcaaaagacggaacgtgcaaaagtttcggtgaaggcggggacggatttgttcccggtgaaggtgtcggggccgtgctgttaaagccgctgtcaaaagcgatggctgataaggaccatatttacggggtgattcgcggcactcatatcaatcacggcggcagaacaaacggatatacagtgccgagtccgagcgcccaggctgacgtgatttccggcgcgcttgaaaaatcaggaatacatccgcggatgatcagctgtatcgaagcacacggcacgggtactgaactcggagatccgatcgagattgacggtttgacccgcgcatttcaaacgaaaacgtcagataaaggtttttgcgccatcagctcagttaaatccaatatcgggcatttggaagccgcggcaggcattgccggtgtaacgaaactgctgctccagcttcaaaaacgaaagctggctccctcattacattgcagaaaattgaatccgaatattgcattcgaccggacgccgtttgtggtgcagcgtgaattggcagactggaaacggccggtcattgaggaaaacggagcgcaaaaagagattccgagaatcgcgggaatctcttcttttggcgcgggcggggcaaatgcccacatattgatagaagaatatattgaacctgatagggagatttatgagccattcacagatgaagatcccgcagtcattttattatccgccaaacaggaggccagcctgaagcagcgggcgcagcagctttttcaagcgatcagaaaaaatgacgtcacagaccgcagcctccgggatgcggcttacacccttcaaaccggaagagaagcgatggaagaacgtgcggcgtttatcgtgacgtcgacagagcagttagcggaaaaactgcagcgttttattgacggcgggacagacggctgcttcaggggaaaaagcaaacagtataaagacattctagccgtttttaaggatgaagatatgcaggaagccgttcgtaaatggatgaaaagaaaaaaattcgcgaagcttctggaactttgggtaaaagggctgaagattgaatggtcagagctttataacggcagcctgccgcatcgcatcagccttcccggttatccatttataaaggatcggtattggccggacgatgcagcgccggacaatgttcgtgatgctgaaacacattctgaaacatttcgtgaaatccgctttttacagaaaagctgggcagaaagcagccgtgttccggctaaggaagtgcggggcgtcatcggaatagctgctgatcaccagacaggaaatttagccgttgagctgtcccgttatttccccgagtctgaaatcattgacgctgcatcaccggaaatatccggggacgcggcccgatttggcggtctgattgatgtgaccggatgcgggacggaaatcaatcatgatgacggctggattcatcgtctgcagtctctcattgacaacagaaaccgcggccgaaagcttcagctgctttgtgtgacaaaggggcttgaaccctttgcaaatgaaacgataaatctctcaggtgcaaaaaaggccggattgtaccggatgctccaaagtgagtataaggatatccgctcgcggcatatggatgcagaacggactgccgaagatcctgagctggcaaaccagatcgcagaggagttttttcgcgattctgaagacatcgaagtgtgttaccgaaacggtgtgcgctatcacgcgcggttaaaggaaacaaacagcttagctgaaaaagaattttcatttccgaaagaccatgtgctctggatcaccggagggacccgggggctcggatatttattcgcctggcattttgccgaacgatacggagtcacgaaactcgtgcttaccggaaaagaaacaatgccgccgaaagcggagtgggatgatcatatcaaacggaattccccgttttccgaaaaagtgagaagaatcagagagctcgaacaaaaaggtgtccgaacggaagtgctgtctgtatcttccggccctgaatatgagcaggctgtcagccgggtgaaagagaagatgggcccgattggaggcgtgatacacgcagcgggagccgtagatctcgatcatccggcctttatccgcaaaacgagagaacagatgatgaccgtgcttgaacctaaaacagacggactggaccttttgtatcaagcgctgcacaaggagcctctccggttttttgcgctgttttcttcagtgtccggcgtgatgccggaattaggagcgggacaaagcgattatgccatggctaacgcctatatggattattttgcggccgcaaaaggttttccggtgctgagcatccagtggccgagctggaaagaaacgggtatgggcgaatcaaaaagccgggcctatctgaaaagcggtttaaagagcatcactgacagagaagggttgagcctgtttgatgccatcatggcaggcgattgcggatctgttattatgccggccgtcattcacccggaaaaatgggagcctgaccgtctgctgctttcatccggccttactgaaacaaagcagcaggaacaggccgatacagaaagcgttaaggagtggctgacgggcatttgctgccgggaattaagactggagccgtcaagatttgaatctgatacaccgtttcaagattacggagccgattccattatgcttgcccaagtgtccagagcgatcggaaagaggatcaaagctgaccttgacccggcggtgctgtatgaataccctacggttgctgcgctggcgggatggcttgaaacagcatatcccgaaatcaaagctgccgtttcaaaaccggttcagcctgtaatcccggacgttcccaaacaaactgcagccgctgttattcagccttctggtgctagagcggcgcaggacattgctgttgtcggaatgtcctgccgttttccgggagctgaatcaatcgaagcttattggaagctgctgtctgaaggaacgtcagccattcaaagagttccgaaagagcgctggaaaacggagaaggcggattatgcgggccttttacaaaatgtaacgcattttgacccggagtttttccttattcccgaagaagacatcaaggcaatggatatccagtcctttcttatattagaagaggcgcttcatctgttcagagacagcggttactcgttacaagaaatgaaaggcaggtcagccggtgtctatttaggaggacgcggcggcagtatgcctgatgaaaaccgtctgaagcatgcaaaaaatccgatagtcgccgccggcccgaattacttggcggccaatctttctcagttctttgatttgaaggggccgagtctcgttttggatacggcctgttcttcagcgcttgtcggtatgaatatggcgatacaggcgctttcttgcggtgaaatcgactcagcggtagtcgggggagtcagtctgctggaatccggtcaaacccaccggatgttcgaacttcgcaatctgttaagcgaagagcctgcgtttcatatttttgaccgccgcaccggcggcatcgtattgggagaaggcgtcggaatggtgtatttaaaaacagcggcccaggctgtaaaagacggtgaccggattcatgcggtcattaaaggcatttccgtaaacaatgacggcagaaccgcggggcctgccacaccgaatatacaggcgcagaaagaagtgatggccaaggcgcttgccaaaagcggcagaaaagcggaggatatcagctacattgaagcaaacggttcaggctctgaagtaaccgaccttttggaactgagggcgattgaagcggtctaccgtatgcaaaacagcgcgccttgtgaattgggatcgatgaagccgaatatcggacacccgttatgcgctgaagggattgccggattcattaaaacagtgcttatgctctcgcgccgaatgcgtgtgcctttcctttcgggcaaagagccgatgacgcattacgatctgtccgcctcgccgttttatttttcgcacgctctgcgtgaatggacggattcaccgcggattgccgccgtcagcagcttcgctgacggagggacgaatgcccatgtcatagtggaagcctgggagcaggaggcgtataccccggttagaaagcctttgccgagacaggaattaaaacgccggcccatccgtccggacaaaaccgaaagcctgcatgaaaacacacataagtcccgtccgaatacgttttggaaacaaatgaagacttactgattgcgctgaaaattgaacgtcgatatggaggaagttcatatgcaagagcagcttcttattaacaatcagcatcccgttctgaaacatcataaagcctatggaaaggaactgctgccgggtctggcttatattgacctgatctatcagactttcagagaaaacggcttttttcatgccggccttgaactcaggcacttatcgatttttcaccctttagctcctgaacagggagaaacaatcctgctttccgttgactgtacagagaacggcgaagggcagtggaaggtggaggtgaaagggcaaaaacaaggtgacgaagcagcagagacaaaggtatatgccgcggcgcaaatgcattccgtcaagcccgccggcttccaagagagcgtccggatggatgccgtaaaacaaacggcggcagaaataccgcttgaggacatttacgcggaatgcagggatcaagaactggttcactcaggaatgatgaaaggctgcggaagcgtctaccaaactgaaaaagagatttatattgatctgtcggtgcaaaaggatcagctggaacatgcagaagaggcgatgtttcatcccgcattgatagatgcgagcagcatcggctccaatgtatatctcgctcctttgacgagggaggaggggcaattatttctgccgctgttttatgaatcgttttattgcaccgaattgctgcagacgacatgtatcaccaagataaaaaaagaatccgtcacccgtaagaaagatctcgtttacgtgacaatggagtttttcaatgaggaaggcagaaaagtcggcgaactgaaaaacttcgccaataaactggtgagggacccggaactgatcaatcagaaacggcaaaagaaagaacctgacgggcggaatgccgtcccggctccgcaagcggaaccggcgccttctgagccccgccgtgcggaggcttccgccggccttactgaacagtgcatcctttatttaaaagaattgcttgccgcccgattgaacaaacctgtgaaagagattgacccggatatcggctactatgaaatggggctggattctccggggctgttggacatggtaaaggaaattgaacgaaaaatcggaacgcagcttctgccgacactgttatttgaatacacgacaatcgcggaattggcgggatatttgtgcgaacattacggagccggtttcggccatgctcaaagcgggcattcaagtgctgagcctttgccccgggaaaaaaagaggacgacccaaatccgcgtgaaaaaatcggcgtcagccggaacgcagaatggagatattgcgatcgtcgggatggcgggacggtaccccggcgccaaaaatcttcgtgaattttgggcaaatttaaaaaatggagaaaacagcgtaacggaagtgcctcgttcccgctgggatacgaggacatatgagcatttgcgatcgccgtccggcaagccgatttccaaatggggcggttttatagacgatccggattgttttgatgcgaaattttttcggatttctccgcgggaggcagaagctaaagatccgcaagaacgattgtttttagaaacatgctgggaaacgattgaggatgcaggctacaccccggaaacaatcgttcagccgaaagggccgaataagagaatgaacgtcggtgtgtttgccggggtgatgcatatggattattctctcgccggcgctgaagctgcggccaaagggctggtctttccttatcccttgaactatgcgccgatcgcaaaccgggtttcatatttttgcaattttcacgggccgagcatggcggttgacacggtgtgttcgtcatctttgacggccgtccatatggcggcggaaagtctgagacgcggtgaatgtgaagcagctcttgccggaggcgtcaatttatcattgcacccgacaaaatatatcacatacggcttgatggatatgcattcgagtgacgggctgtgccgcacgttcggcgaaggaggcacaggctatgtctcagctgacggcatcggagccgtgctgctgaagccgctccacaaagccgaagaagataaggatcatatttatgcggtgataaaaggcagcgccgtcaatcacgtggggaccgtcagcgggattaccgtgccgagccccgtggcgcagggggatatgatagctgaatgtcttgaaaagacggggatcgatccccggacgatttcttatgtggaagcgcacggaaccggaacttctttaggagatccgattgaaatacaaggtcttgttaaagcttaccgcacgtttacggaggatcggcaattttgtgcgatcggttccgttaaatcgaatatcggacatgcggaatcagccgccgggatcagcgggcttcataaaacggttttgcagctgtttcacaaaacgcttgtcccttctttgcactcagagacgattaatccgtatctccgtttagaggactcgccattttacgtgcagcaaaaaaccgagtcatggaaaaggccggcgtatacagagaacggccgtgaacatgcctgcccgagacgcgcaggcatcagttcattcggggcgacgggttcaaacgttcatctcattttagaagagtacaggcctaaaaaccccggtattacggaggatcaagagagaccgtatatcgtgcctctatcagcgaaaaatccggagcggctgaaggaatacgctgcccgcctgctgatgtttctcaaagataaagcgcttgaaggaagcggtccgcttcatgacaaaagagatacaatgcaaaatcagctggaaaatgcgttgcgaggtgttctggccgaagttctgcatgttgcggccggctcggtagatgatgaacaggattggaaggaattcggcttggatgtcatgcagctgacacatttttctgagctgatgacggatcaatacgggctggcaatagacatgactgatctcatacagcatacttccgtccggactttagcagaatgtcttacaaacgatgagaaacataagaatattctttccggtcttttcggccagtcgggcttagataagcagcctgatgaatctttttccttgcggtcactggcgtatacgctgcaaacgggacggctggcaatggaagaacggcttgtttttttagtgaacgatcaagcagacctgatcaggaaattaactgaatttacagaacgaaaacagcagattgacggctgctttcaagggcggtctgatagcggaacggaaatcaggggtttcctgaatgatgatcaggatacggaggagctgatccgaaaatggatggacagcggcacttacaaaaaacttgcggagctgtggtcaaaaggatttgagatagactggacgcggctgtatcgggaggagaaaccgcgcaggatgagtctgccgacgtacccttttgcaaaggaacgatattggataccggagcccgatcatcccgtcacttccgtaaatacagaaagcaggcttcacccgctgcttcaccgcaatacatcagatttgctagaacaaaaattcagtacgatactgaacggagatgaattcttcttagccgatcatatcgtccgaaacaagcgtgttctccccggggcggcttatcttgaaatggcgagagccgcagctgaactggctgccgcgccgttagccgctggatacacggctaaaaccggcatttcgctgcggtatatcagctggatacgccaggccgttcataaaaaagagccgctgcgtatgacgacagggctttctttggaggataacggcaatgtttcatttcaagtgtacagcaatgaaaatgattcagacatttattgtgaaggaagcgctgtgattgagccgctgtctgaggcgccggttttgcatattgaacagctgaaagcgcgatgccgcaaaaaagtgctgtcaaaagaagactgttatgcggcgtttgcaaaggcggaaattgtatacggaccttcacatcaaggaattgatcacatttattgcggggaaaaagaagccttggctaaattggtgctccctgcttccgtttctgatgaggctgaacagtttgtgctccatcctagtctgatagattctgcttttcaggcggccatcggcgttatgaatgaagatcaagcgggttatccggagcagccgttaatgccttttgaattgcatgaactgaccgtttttcatccgtgcagtccaaacatgtgggcggccgtatttgtgacgcatgaaacaccggccgtacgaagaatggacattgatatatgtgatgagcgcggcaatgtgtgtgtaaggataaaaggattttctgcccggatggccgaaagtgcgccggccgtaaccgataataagcaatacgatctcccgggtaaccttaccggagccgtcaaactgatgcaggtatgggacgcggaaccgatagacaaccaaaccggcttccccatttctgaagcaaaagctgtcatcataggcggtacagacgggcaggcggacgcggttttacgattgtttcctaaagctgtgagatttgatatcggccaaagtgcttccgttgaagtgatatctgatcggctccgccgtctcggtgagattcagcatatgatctggtttgcccctcagccggctgattctcacagccatgatcaaaaaagcggggtgctgcaaattttcagagcggccaaagctcttatcggtctcgggtatggaaaagagcagctagggatgacggtgattacgcaccaagcacagcctatcacccaatatgatgaggtgcgtcccgctcattccggtgtgcacggttttgtcgggtctctcgctaaagaacatccgagctggcacatccgtctggccgatcttgaagacgggggggatttccccgcagaagacatattcagcctgccccgcgaccgtacgggtaaagcatgggtgcgcagacatcaggaatggtaccggcctcaattgcttccggtccaaagcgggccgtctgaaagtgttccttaccgctatggaggcgtatatgtcatcatcggcggtgcgggaggcatcggcgaggtttggacagattatatggtgacgacgtataaagcccgagtcgtctggatcgggaggcggccgctggacagccggatacgccaaaaaatagaccggtactggtcatcaggcccggctcccgaatatatagccgcagatgcttctgattttccatcgcttcagcgcgcctatgaacagattaaaaacacatacggcaccatcagcggcgtcgttcattcagcgatggtatttgcgaatgaaagcgtaaaagatatggaagaatcacagtttcacgccggccttgcggcgaaagtggatatttccgtcaacattgccgaagtatttgcgaaagagtctttggactttattctctttttctcttcggttatttcatatattaagaatccgaatcaaagccattatgcggcgggatgcgcatttaaagacgcatttgcccatgagctttccggacggctgtcatgccgggtcaaagtgatgaactggggttattgggagcgggctgacaatcacatttctgaagagtttgacagactgagtgcaatcggtctcgggctgatcagccgggcggaagggatgcaggcgctggaaactctgctgacgcagccgatctcccgcatggggctgatgaagctgaccaagccgattccgatcgagggaatgaaccctcatgaatttgtgactatctgattgcctgtcaaaatgacggagcaaatttaattttcttaggaggataaggttttgggtaagggagacaaacaaaaagaccgtacacagttatccttaagagcagaaataagcaatcaaatgaaagaattgaatcggcttttgctgcaagtgctgcgggtgacgctgcgttcaatgggtctgaccggcgaagcgccggcggcttcctgtctgcctttatatgaacgctggctggaagaaagcatccgtcttttagacagcgattttaaaagcggtgaaacggccgcggtttgggaagagtggcataagaagaaaaacgaatggctgaaagatccggatatgaaagcgcaggttctgctggcggataccgtcattcaagctttgcctgacattttaacaggcaaaataaaagccactgacgtgatgtttcccgattcttcaatggagcttgttgaaggaatctataagcataatattctcgctgattattacaacgatgtgctggcaaatgaagcgtgtatgtatgtggaaaatgtaatgaaaaacaatcctgaggcaaacatccgtctgctggagatcggagcgggcaccggcggaacgagcagtacactgtttaaaaagctccgcccctatcaaaaccatattcaggaatactgttataccgacttgtcaaaagcttttttaatgcatgccgaaaaggaatacggcgcggacaatccgtatttgacgtatcagctgtttaatgtggagcagcctgcggcgggccagggattacatctgcgaacctacgatatcgctattgccgcaaacgtgctgcatgccaccaaaaatatccggaaaaccttacggacggcaaaagccgtattgaaaaaggacggtttgctgctcgttaatgaactgggcgggcatacgccgtttacacatgttacattcggcttattagagggctggtggctgtacgaagacgaggcgctgcggattccggggtgtcccggtctttatccggaaacatggaaatccgttttaatggctgaaggttttcattccattcaatttccggctgaaaacgaacgtctgcacacccagcagattatcacggcgaaaagcaacggagtcatcaggcagagcagggaagcttacaccgcgcaaaagcgccaatcaaacgtaccgcaaacatcctctgatcgtcagctccccatcaaacaagcgggagaggggctttcggaaaagacagcggcttttctgataaaggctgcggcaaaagtattaaaaatgccggcagaagagataaatccgctggcttctctggatgaatacggcattgactctattctgatcgttcagctgacgaatgagctgcgggatctcgtccctgatatcagtagcacgctgttttttgaataccggacgataggagagcttgccgcattcttggctgaaacgaaggagcgcgaactgcatgcgcaattttctgaagaagtccgtcatactgaagcggcatcatccggctctttgcttgaaaaaagcacagagtacctgaaacagatcgtcagcgccatcttaaagatgccgattgaggacgttcaagcccatacgccccttgaagaatacggaatcgattccatcttaatcgtacagctgaccaaccgcgtgcgggaagacgtccctgatatcagcagcactttgttcttcgagtatccgacaatcggcgaattagcggactatctcgtcagctcaagacaggaagatatggctgggattttaagaacaaataaagaagccgaaaaggcgccgcacactttacagaaaaagcaaagccgtaaacaaagcgccggattgacgaagcgccaagcggcatctttttctgaaaaagcgccgcccgcttccgaaccgccgtcaaaacactttgaagtggcaattgtcggtcttgccggacggtatcccggagctgaaaatgttaatgagttctgggaacggttaaagaccggtgaacacggaatcaccgaaattccgaaagaccgctgggattggcgggactactatgatgagacaaaaggtaaggaaggccggatgtatacaaagtggggcggctttttaacagatattgataaatttgatccgctgttttttaaaatctccccgaaagaagcggagcgcatggacccgcaggagagactgtttctggaaaccgcttatgcggccctggaggatgccggatatacccctgattcactatgcgccggtaaaaaggttggtgtctttgcgggtgttatgaacggcaactatccgacaggggcccactaccactttatcccgaaccgcgtatcctatgtgtttgattttcacggtccgagcatcgcggtcgataccgcatgctcctcatccttaaccgccattcatctcgccgcagaaagcatcagaacaggtgcatctgaatgcgcgattgccggcggcgtaaacctgattacagatccggttcattatatcggactttcttctatgagaatgctgtcaccgtcaaacgcgtgcaaagcgttcggtgataaggctgacgggtttgttgacggagagggcgtcggctgtatcgtgttaaagccgttgaaaaaggctgttgaagatcatgatcatatatacggtgtcattaaaggaagcgctctgaacgccggcggcaaaacgaacgggttcaccgttccgaatccgaaagcacaaggagaagtgatcgcagacgcgatggagcgggcagggattgacccgagagcaatcagctatctggaagcccacggcaccggcacttccttgggagatccgattgaaatcgcagggttaaccaaggctttccgccgctatacggatgcaaagcaattttgttccatcggttctgttaaatccaatatcggacacctggaaagtgcggcgggcattgctgcggtcaccaaaattcttcttcagatgaaacacggatatctggtgccgtcgctgcattcaaagcagctgaacccggaaattgattttgaaacttctccttttatcgtgcagcaggaaacggcggaatggagacggccggtcatagaatctgaaggagtaacacgggaatatccgagaatcgcgggtacatcttctttcggagcgggcggtgcaaatgcccacctgctgatagaagagtatgaaccggctgaaatgacttcggcagacaccggccgtccggcgctttttgttttatcggcaaaagataaagaccgcttgcgcgagcgggctctgttgctgtcggatgccgccggacacggaacaattacagatgcgaatctgcttgacgcggcatttacccttcaagtcggcagggtcccgatggaagaacggctggcgatgacagcggactctgtttctgaattggaacagaagctgattgcttttctgaataattccggttctgtaagcggggtgtttacgggccggagtgatagtgctgtcacggagacgggaggcacagtcagtgaatggatggaaaaacgtcaatttgacagtcttttgaatgcctgggttcacggggcgcccgtcgattgggcatctttatataaaggcgcgctgccgcatcgtatcagtctgccgtcttatccatttgcaaaagaaagctactggatgaagcgggaagaaccaaaaacaggaacaactgaatatgtgcatcctttcctgcatgaaaatacgtcaaccttggcggagcaaagctatcatacatcttttacaggccgggaacacgttttccaggatgtgagcggggagcgggttttgtcggcagccgtttatttagaaatggcgcttgcggcttttcatcatgcggcagacagctctgaagaaaaagagatatggatccgaacggcggcatggactgacccgattaccggcggacatcacggtgcgggcatcaatctctcccttctgtctgaagacgaggaaggcatccattatgaaatatacagtgacgaagagaagctgcatcattatggaatcatcggacaagggaacatacagccatcccgcgtgcttgatattgcctccttacaaaaagactgccgcccgctgtcattcgattatgaaacaccaggcacatcaggtgtaacgatcagtaaggagttccgcaccgttgaaaagctttatgcgggagaaagtgcggtttgggcgaagcttgctctcacagatgaaagcggctgtaatccgggatatcatctgccgccggaatttctggacgcagcttttcatgtcctggccaaaacggagccgtcagtccatatcgtgcctgaagcggttgaagaactgcgcgtcatgcgtccgtgctcatccggcatgtggatgtatattaataaaaagaatcaaaccggctgtgacattcaattttgtgacgaaaccggcactgtctgcgcagaaatcaaagggataagaatgagacagccgtctcagcaggatcacgggcaagaggaacaatccgagatgatgatatttgaagaaatgtggaagcagcagcctctgaagaaatctattcatgaagagctgaaaacggtcatctgttttcttacgggagaagctgccagaaagcatgcttatcagtctttacaaaccctttatccgggagccggcgtgttttttatttcacagggtgaggaaactcaaaagctttcaaacacgcattatcaaattaaaatcactgacggacaagcatatcaagaaacgtttcggcatattgaaacggctgcaggcaaagcggatgccgttttatatggatggccgcttgaagatgaaaaggccgtgaaagactattccgttctgtatcatgtgatccgcgcagctgcttctttgcgttctaaaccgaggcggatccttctttccgctcagtgcgggagcgataccgatatcagttacgccgagtcatggatcgggctggaacggtcgctgaaactgatcttgccggagacggatacggccgcggtttattttgaacaaaaaggaccgttagaaaaactgatccataacgtatgtgaagaacttcacagcgagtcgttcggcagtgtcatgtacagtgaggaaatccgccacgtcatggaaatgaagcagacggatatcgcccctgttgagaagcgtgtgataaagagcggaaaaacgtacttgattaccggcggatgcgggggattaggcttgttatttgccggatatttcgctgaaaaaggaccggttacgctcattttgacggggagatcagcggcagccggcccggtgctgaacaagataaagagattggaagaatcaggcgccaaggtgttttacgtgcaggcggatgccgcagatcaggcccagatggagaaaggtttgcaagaagtgaaagagaaaggatgcgggccgattcacggtgtcattcacgctgcaggtcttcaaggcactgaaagcattctggagaaagatctgcaaacctttcagcaagtcttatcgccaaaagcggacggcaccgcggtgttagatcaggttctgtcacgggagccgcttgacttcttctgttgtttctcttcttcttcagcgattttaggagacttcggttcttgtgactacgcgatggggaaccgcttccaaatggcttttgtccgtcatcgggataaacttgtgagcctcggactcagaagcggcaagtcacttgcaatcaattggccgctttggaaagaaggggggatgcatgtcggcacggcggaaagcaccgatatgtatttaaaatcaagcggacagcgttatttatacactgaggaaggactcgaagcttttgaaacattgttagtccagccgtccagccagtatctcgtcctggccggttttccgtcgagggccaaacgcttcctgcagatagatcaaggcgaacggccgatttcgggttctgtaaacaggaacgtcccgttttcaggaaggcggagtgaaatgaaaggctttacactggaagaatgcgtaagctgggatgtgaaagaactggcggcggggcttttgaaaatagacaagaacagactgacggacgctgacaatctggctgatttcggctttgattctatcagtttggcggaattcgcctcttctttgtccgcccattacggaattgaagtgacaccggccctgtttttcggacattccacactggagaaggtcgtccgctattttctgacggaacacaagtccgtcatggagcatgtctatgaagaaaagaaacctgaatccgcagatcaatctgtctttgaaaaggcaggaacggaaaagcgaaagaagcagaggggaagaaataagctgaacgccggaaccgagggcagtcaggcagctgattccattgccattatcggcatgagcggccgatttcctcaggcgcgcacggcggacgagctgtgggacattctgtttcaggaaaaggatgttgtcgcaccggtcgcaaaaaaaggcttcacaagttcaaaatggaaactcggcgctgtaccgggggcggacgaattcgaccctttattttttgaaatatcgccgagggaagctgaaacgatggatccgaaacagcggctgcttcttcaggaagcgtggagggcccttgaggacgccggctacggcgccagtcacatcaggcagcagacgatcggtatgtttgtgggggcggaagaaggagattatcaccttttaacacgggacaaaggcaatgtcacgtctcatcataacggtattttggcggcacggctggcttatcacttgaatttatcaggtcctgtgatggcgataaatacagcatgttcttcggggctcgtttctgtccatcaggcggtattaagcctgcagaataaagagtgcacaacagctgttgcggccggggtgaatatcatgaataccccggacttttttgaaacgatagataaagccggaatgctgtcggaaaacgggaaatgcttcgcgtttgataaaagggctgacggcatggttccgggggaagcggccgcggcggttgttctgaagccgctgagagaggcggaaaaagatggtgatccgatttacggggtgattcgggcgagcggcatcaattatgatgggaaaacaaacggaattaccgctccgagcggcgtcgcgcagacccggctgcttacttctgtttatgaccggggccgtatcaaccctgaagatatcgaatatatcgtcacacacggcacaggtacaaaactcggtgatccggtggaaattaacgcgctttatgacgcattttctgcctatacaaacgaagaagctttttgcgcgctcacatcaattaaaaccaatatcggccacacgtttgccgcatcaggcattgtcagtttaatcagtcttttacaggcgttctcccgtgagatgattcccgccagtctgcattgcagcggggaaaaccgctatatcaactgggagaagagtcctttttatgtgaataaaacgggtagaccgtggccttctctgccgggtaaaaaccgaatgggggcagtcagcgcattcgggatgagcggaacaaacgcccatgtcgttatggaaagctataagcgcagcgcttcacctcatcgtgatgcccctgcatatttacttactttgtctgcaaaaacagaggaggcccttcaggaaaaaatcgaagatatgatcacttgggcggaaaatggcggactgaaagaaaatgatctggcccagctcagctatacgttgttaaaaggacggcatcactttaaccatcgcgccgccatcgtggtgcaagatgctgatgacgcagtgtatgtatggaagcaggcaaagcttaatgaacatcatccttatgtgttttcgagaaaagtaccgcagcactttgcagggcgtcagcatattcaggagcacataatagaagtgctcggcaagtgcagcgcctcatattctgaccatagaaaatatcaggagctgttatgcgtgctggcagatttttattgtcaaggttatgaaatcgaaggggacttgctttatggcggacctttgccgcgaatcggcaatctgccgggctacccgtttgccaggcagacgtattgggcgtccgatcgtcttcagggagagcttgaaagccggaattcagacgaacgtgaaaagcttcacccgctgctccatgcgaatacatcgaccttgaccgcccagcgctttacttctgttttttcagggcatgaaccgttttttaccgatcacatcgtcaatggaaaaccggtgcttccgggcgcggctgctttagaaatggcccgggccgccgttacgctggctgctgaagacttgcccggcgggaaaacgggtgtaaggctcaaacagatcgtttggctccgtccggtgacggcgctttctgaaggagtgacgcttcatgtaaagcttcagccgggagaaaacggagacatcgcttttgaagcgtatgccgaaggagaagagccgcttgtctttttccagggaaaggccgtgctcgaagagacggagtgtgctcctgttctcgatgtggaagcggttcaggcgcgctgcagcggccgtcacttgtcaaaggctgagtgctatgaagcgttcgacagcctcggcatcacctacggaccgtcgcatcaggcgcttgacgccgtctatgccggaagcggagaagttctcgcgaagctcactcttccgccgtccgcccgcgaggaaaaggatccgttcatcctgcatccgagcatgctggacgccgcccttcaggcttctatcggtctcgtgctctcagacggttccgcgtccggacggccgtttctgccgtttgccctgcaggatatgcaggtgttttctgcgtgccgggagacgatgtgggcggtgctttcctcagcggacggcgcctatcatattgagctgtgtgatgaaaacggcgcggtatgtgtccgattgacggggctcaccgcccgttttctggaagaggaaacggaggaaaaaccgctcttgcttcagccaaagtggcaggaatcaccgccagatgaaggcggcggacaagaagagtctttcagatacgtgacgctgtatggcggaatgaacgctgaggacataagcggcggcgccgtatgtgcggctgacggcgaaggtccgattgaagaccgttatgacgcctgcgcggcggagctgtcagcgatcgtcacgcgtcttatcaaagaaaaacagaagaaaaaaacgctgatccagcttcttgtccccgacaggggggaagacaatgtattggcggggctggccgcttttctgaaaacggctcaccttgaacatccgaagctgtacggccaagtcatccaagccgatccggacgagtcagcctcggcgcttcttgccaagctgaaagaaaaccgggcgcatcctgaacaagcggaaatccgttatgaagacggcaaacgtctcgtcagaaactggcgtcatctgccggcgcctcaaagcggcgccattccgtggaaagacgaaggggtctacctcctcaccgggggagcgggcggcatcggactgattgtcgctgaagaaatagcctcccgcgtcaaaaacgccgtcctcgtattaacgggaagggcggaagcgcttgataaagaccgctccgcccgcttacggcgcttggaagcgtcgggtgcccgcgtattgtatcaaccggttgacgtgacagacagggcggcggtcatcgccctcgtccgcggcatacaggaggagcacggaacactcgacgggatcattcacggcgccggcgtgatcgctgacaactacattctgaaccagacagaaaacgaacggaagaccgtcatggcgccgaaggtgaaagggcttatcaatcttgatgaagcagcgaaagatgtgcggctggactttttcatcctgttttcttccttggcgggaggtatgggaaatccggggcaggccggttatgcggcagccaacgcatttatggatgtttatgcagcccgccggaaccgtctcgtgcgggacaacgagcggagcgggcagaccctctccgtcaactggccgctttgggaagaaggaggtatgcgcgtggacaaagagaccgaacggctgatgtatgaacagaccggaatgaaagccatgcgatcggcctcaggcatccaagcgctgtacgccgcttttgcctccggagaacaccaggtcatggtggcagaaggcgacgaaaaacggattcgcagccatattttcgatctgggcgaaaaacaaagcgccgccggacaagctccggcagtggcagatgcaagagatctgaaagatcaggttcaagagaaactaaagcggcatgtatcagatctcttaaaggtaagcatgaaagatattgaggctgacagcgaactgacggaatacggatttgattcgatcattttcactgaatttacaaatctattaaatcggtcttatcagcttgagctcagcccgactatcttctttgaatttccgacattgcgcaaactgagcggccatttgatatctgaatggaaagaagcattcagcggcttagaaagagagagtttaaaaaccgctccaaaagccggaataagaaaagctgaagctccggcggccgttcatgtcaagcgggaaacgcccgtatccgtaaaaggaaaatcagaagaaaaaaccgaaccgatagccattatcggaatcagcggtatttttccgcaggcgaaagacatagatgaattctggacacgtttacaaaaaggagagcattgcatcacagaaattccccgagatcgctgggattggcgcgaatattacggcgatccggcagcggatgcaaataaaacgtcaattaaatggggcggtttcatagatggaatcgccgggtttgacccgctgtttttcgggatatctccgaaagaagctgaaatgatggatcctcagcagcgtctattaatgatgtatgtgtggaaagccattgaagacgcggggtactcagcaaaacggattgccggaacaaaaaccggtattttcaccggcacattgggaagcggatatcaaactttaatcaacaaggcgggtcttcctgtcgaggggtatacgatgaccggaatcgtgccgtccgtcgggccgaaccggatgagttattttcttgatatccacgggccgagcgagccggtagaaaccgcttgttcaagctctttagtcgccattcaccgcgcggtaaaagccattgaaacgggagattgtgatatggcggtcgcagggggcgtcaacacgatcgtcacgcctgaagggcatatcggttttcaaaaagcaggcatgctcagtgaagacgggcgctgcaaaacattttccgatcaggctgacggttatgtcagaggagagggtgccggcatgattgtcttgaaaaagctttcagaggctgagcgtgacagggatcacatctacggcctcatccgcggtacagcggaaaatcacggcggacgctcagcgtcacttaccgcgccgaatccgcaggctcagacggatgtgctgaaaagcgcttatcaaaaagccggtattcacccgtcaacgatcacttatatagaagcgcacggaaccggaacggcactcggagatccgattgagatcaatgcattgaaaaaagctttccaaacagacggggcgccgggcggatattgcgggataggctcagtcaagacaaatatcggacatttggagctcgcagcaggtattgcgggcgttatcaaagtattgatgcagctgaaacatcggacgctcgccaaaagtctgcattgcgagaacatcaatccccatatcaaattgaaggacagtccgttttacattgtgacagaaacaaaggagtgggaagcgctgcgtgatgaaaacggccgggtcctgccccgccgggcgggtgtaagctcattcggtttcggaggtgtcaatgcgcatatcgttattgaagaatacatgggcagaagtgagacggaacagcaggaaacccgtgagaaagcgtcatctctttttgttttgtcggctaaaaatgaagagcggctgaaggaaagagcgcgtctccttcgagattttatccaaaacggatcatcccgccatatcgatcttgcagatgccgcatacacactgcagaccggacgggatgcgatggaagcgaggctgggaatcattgcaggctccgcagaggaactgactgaaaaactgaacgcgtttctgttgggaaaaaacagcgaagatatcatcagcggccgtaaaaaacgcgagaataacacgatttccatgttctcagacgatgaagacgcggctgacctcgtcagcgcctggcttgagaaaaagaaatacaggaaagtgctgcggctctgggcaaacggatttgacacagattgggagcagctgtatacggacaggaaaccgcgccgcatcagcctgccctcctatccgttcagagccgaccgctattgggtgccgaaacgggagcagctgccgctttcgaatcaaaaaacagtattattgcaaaaaacatgggaaccgtgcgaggcagtgtcttcatccgagccgttcaacaacaaaatagcgctcatcgtctctgaagatacaaaagaccttgccgccgaggtgaaaaaacagctgaatgatgctgacattgtgcaggaaaatcagctcatctctttcttacaggatccgaacgcggccatctattccgggtttattgacttcaccggctgcggctcccgacaaaagcggcaggacatcagctgggtggcatcgctgcagcagctgattgaatacggccgcggacaagaaaacatgaaaatgctttatcttacaaaagggcttgaagccttcaaaaataaggctgccgtcatgcatggtattgaaaaagcggggctttatcgcatgctgcggcatgaatacagccatattctcacctgtcacgccgatattgatcctgaagggccgctggagcagacagccgcttttattaaacaagaaattgaatcagacttaacggagtctgctgtttgctgcagggacggcatgcgcttcagctatgttcttcggcagactgatcagattgaaccagaagccgtgcaaacagaccggactgcgtttccaaatgacgccgtcctgatgataaccggaggaacgcgcggactcggcgctttatgcgccaagcatttcgtttccgcatacggtgtgaagaaactgcttctgacaggcagaaaggagctgccgccgaaaaccgagtgggatcttgagcaaacagaccctgtcgtttcggaaaaaatacagcttatccggcagctggaatcacaaggcgtaaaagtgtgcgtctcagcagttgatctgacggataagcaggccgtcggacggcttataaaagaggtaacctcaacgctcggacctgtcggaggcattctgcattgcgcgggaattgcggaccgtgaaaaccctgcttttctccgtaaatccaaagacagtattgcgcgggtgctcgcgccgaaagcagacggccttcacagtctgtatgagagtgtaaaggatgatacgccggcatttttcgttctgttttcatctgtctcggcatccgtcccgattcttgcggcgggtcagagcgattatgcgatggctaattcttatatggactattttgcagaaaacaatgagagcggcatcattagcatacaatggccggcatgggatgagacgggcatgagcagggatataaaaagcgggatttatgagcaaacgggattgctgcggcactctgacgctgaaggtctcaagatgcttgattacattttaagagaaagacccggagctgtcgtgctgccggcacaagtgaaacatgattgggacgccaaagcgctggaaaatgccaagccagccgcccataaaggaatgagaacagcttccaaacctcctgaaacaaaaaaacgggaacataaccggattgatattcaatcttggctgaggtcgcttttggcaaaagagctgagtatcgatgaaacgcatatggatatcgatgtgccttttcaggaatacggaatggattctatctttctggcgcaagtgctgacaaagatcgatcaaaaactgccgtccgtttcaattgatccgactgtccttctggaacaccctaccatagaacagctcgcggattatttagccgtacattgtccggaagctttttcggcagatgcaacagttcccgcggagaaggtccctttgcagaagacgccgaaacggagcaaaaaaacggcagataaccccgggaaacggggaaaggttgcgatcatcggcatggcctgtcattttccgaaagcgggggatataaaagaattttggaagaatctccgcagcggaacggatgccgtcactgaagttccgccggacagatggagtgccggggaacactatcagccgggtgaatatcaagaaggaaaaagcatcagtaaatggggcggttttattcacgatattgatcaatttgacccggagtatttcaatatttcagaaacgctggcaccgatgatagacccgctgcaaaggcagtggctcgaagtgagcgcggaagctttggccgatgccggttatcaaaaagaggatctctggggccgccgtatcggcgtttttgccggtgcaagggcaggtgcgttccatcagaaatttcaatatttgcaaaaagacgcgattattggcgcggggcaaaattttattaccgcacacatggcgcacatttataactttacagggcccaacctggtcgtggatacggcctgctccagttcgcttacggcaattcatttggccgtgcaggctattcaaaatggagaagcggaagcggcctttgcgggcggggttgacattttgcttgatgaaaaaccttttctcacaatgagcgcggcgagaatcttatcgccaaatggccgttcaaaatctttcgatgccgatgcggacggaacaggaatcggagagggctgtggtgtgctggtgctgaagccgcttgaaaaagcgatagaagacgaagataaaatatacggcgttattgacggctctgcgattaataatgacggcagcacaatgggcgtgacgacgccgaatccccgggcgcagcaggacttgattgagcaggcggttcagtcagcggaaatcgatccggacaccatgacatacgtagagacgcacggaaccggtacattgatcggcgacccgattgaattaaagggattaaccaatgtcttgtctgcttattccgatgaaaaacaattttgcggtgtaggaagcgtcaaaagcaatatcggccacttgctgagtgcggcgggcgcggcgggaatcatcaaagttttgctggcgattgccaatgaagaactgccgccgactttgcattgccataaaccgaacccccgcttccaatttaaagattctccgctttatcctgtgcttgagctgaagcggtggaacggaaaaaaagagatactcagggccggggtcagcgcgttcggtttgggcgggaataacgcccatatcattgtcagcaacgaaggaattccgaaagagcgaaaagcggccatggaaccgaaaggcggccagacagtataccgaaaacagcggtattggcctgaaaaagcacagttgtccgaagcggaagaaaatgaggcgggcacagaagcaatgtttgaaataagcgaggtgtgatagattggcagttgccaccgatcaagtcaaaacgttcctgcagaaaatcagccatacgaattatatcgtccgggatcatcgcgttcatcaaatccgcgtcctcccgggcgtgactttaatagatatgctgtatcggctcgccgccgggtatctcggtgaacgccctatagaattaagacagattatttttaagcagcctgttgtaacatctgaagagtttgataaacacctgtatgtgacctttacgccggcgcgtgacagctggaaagttgagattactagcgaaaaagcaaaaaacggcacaccgcttggcggaaaccgggatgagaatatggaatgccagctttatttgcaagaagacacgccgcgggcaaaagaactgaatattgaagcgttcatgaaaaacgcaagccgaaaatgggacatgcatgacatttatggaattgcaagaagaagccatattgagcatggcgagtttatgaaaaatgaaggggccgtttatcagcttcaggataaagaagaattaatggagcttactctgagtgatttggctgaaggattccgggagaaatttaaggcgcatccggcttttttggatgcgtccacccttgccggctcttcctttgcattgtcggcccaaaagcagaatgacacaccttatattccttttatgatcaatcgtttttgcatgtatcagccgtttccgaaaacgatttacacttattctgcgaaaaacagccgcactgaaagcggcgtatcagatagcgaacctgatgtgtattcggccgacttcacgatttacgacagggcagggaacgtattggccgaatgtgagaaactgacagtaaaaagggtcagacaagcgaatatgattacccatctgatagacaaagagaagccgcctcagcagaacagaagcggccgtggtgagtcggaaaattctgtggccgcagaagacgtgtctgaacagcaaacgccggaacaaaacatggtgacttacataaagtcggaaatcgccaggctggtcaatcgtccggcacaggatattgatgtgcggaaaggcttttatgatatggggcttgactcggcgcatttgctgaagcttgtaaagatattagagcagacttttcaacagcagttttatccgacactgctttttgaatattcatctgtccgccgccttgcggattaccttatcaatgaagcgggctgtgtgctgaaagattcggcaaaagaacggcatacatcagacgctgacactgctgatgaggttctgttttttgaacccgcctggaaagatcatccgctggaaacggcggtgcagaacgggcaaaaacacacccgtcatctcattatcgctgccgatgcagggccccgtctcaccggtgaactcggcgcacattgcccggaagcggaagtgatagaactgaaaagggagcatgaggctgcagatgagcagtttggagcagatgccgagcgcatatttcgtatgctcaaacgggaactgacagaccatccgaaagaacatacattgattcagcttgtatgcgccgttgagaatggagcggcattgtcttccgctctcggggctatgctgaaaacggcacatctggaaaatccggctcttcgcactcaggtgatcaccttctgtgacaagaatgagagattgccaagtgagacggcggcaatgataagaacagaagcagactgctctcatgcaggctgcacagatattcggtataaaggaaatatacggcagatcagattgttcgaacgtattgagaaactggacgggcagacacagtctccttggaaacaaaacggcgtatatgtcattacaggaggcctcggcggtcttggatttctgcttgcttgtcaccttgcagaaaaagaaaaggtgaagctcgcactcatcggccgttcgccggaacagtctgagaagatcagcagactgaaagcattgggcgcagaagttctttacgttcaagcggacatcggcagcaaagccgaaacagagcgggcatttgctcagattacagaaaccttcggccggctgacgggtatttttcattgcgccggtgttttaaaagatcaatttatcatccaaaaagacagttctgacttgaagcgggtgttcctgccgaaaatcagcggcctgattcatgcggacgaagcttcacggaatgaaccgcttgagtttttcgccgtattttcctcattctcggcgttggccggaaatgcgggccaaatagattatgccgcagcgaacgcttttatggatgaatatatgaaatatcgcgattgcagagcggaaaaaggcgaacggaccggggcttctatgacgatcaactggccgctttgggaagatggcggcatgcaggttgacagcttgatgaaagagatcatgaatgatacaacaggcaccagcccgctaccggccggggaagggatggctgcacttgaatatatgctgcgtctcggcaagctgcaatccgttattttatacgggaaagagccggctgtaactgaaagcatgggccgattgggtccaaagggagacaagaacggatcttcattatccaacgcagctgtcaagagaagaagccgaaaacaagagagacatacagaagagcacgatattgcggtaatcggattggcgggaagatatccgcaggcgggaagcatcgatgaattttaccaaaatctgcgctcagggaaagactgcatcacaacaatgccgaaagacagatggaaaggttatcctttctcatatgaagcagatcagttctaccgttacggaggatttttagatcgcatagacagctttgatccgctgtttttcaatctgactccgcgccaggctgaaatgatggacccgcaggcgcggctgtttttagagacggcttgggaagcttgtgaagatgccggtttttatcaagacagaacggcgcgcgggccatcttcacaaaaaagaaaacgcgtcggggtattcgcaggtgtgttttggagccattatgagctgttcggcgctgaaatcacacagcggggcacaccgctgtctatgggcgtgacgcctgcctctgttccgaatatcgtgtctcactgcctgaactttacagggccgtcaatggctgttgatacgatgtgctcttcttcgctcacatccatacatttggcatgtgaaagcattaaaaggggggagtgcgaattcgcccttgccggcggtgtgaatgcggtcacacacccgcataaatatgcgtttttggcgaatgccggatttctgtcttcagaaggcgtctgcaaaagcttcgccgacggcggtgacggttatgtgccgggagaaggcgtcggcgcggtgttactgacaaccgttcaagaagcggaaagaatgggctgtccgatatatggcgtcataaaaggctccgctttaaaccatgtcggaaaaacatccggtttgaccgtgcctgatccggcatcacaggcggaagtcattacagattcttttcagggtgccggcattgatccggagacactgagctatattgaagcccacggaacaggcacgtctctgggtgatccgattgaaattgaagggctgagccgcgctttccgcaaatggacaaacaagaagcggttttgcgccatcggctctgccaaatcaaatatcggccatttagaaggagcagccgggatcgccggattaacaaaggtgcttttgcagctgaagcatggagaaatctttccgtcattgcacacggacacgctgaatccccatattccgtttccggacacgccgttttatgtggcggaccggctggaagaatgggaacggccgtcacatcctgaccagccgagaagagcgggtttaagttcttttggcgcaagcgggagcaatgcccattttgtcatagaagaatatctgccgccgcaggctgaaaagaaaccggtgagtatacgggaagacgagcctgttctgtttctgctttcggcaaaaaatgaagaacggctattggaatatgtcaaacggtatgaccgctttttacgggaaaaagaagtcaaccttaaagacctggcctacacgcttcaagctggcagagaagcgatgcctgaacggctggcatttatcgttacatccgtttgcggcctgcaagcgaaactgaaggatgtgcttgaacggaaaacagaaattgaagggtgtttccgcggacatgctcaaaatgatatttcatcaagtggaatggccgagctgctgaaaaacaagcaatattccagattgctcactgagtgggcaaaaggagccgccgttgactggagcctgttatatgaaggagagaaggcgaaacgggtcagccttcctgtatatccgttcgcgaaggagcggtattgggtgcctgtgcctgcggatatccagaaacagacagacgaaccggcggaaaaccaaaagatcattcttcaaaaagactggaagcagcaagatccggcggagtctgaagcattatcaggaacagtaatgatacttgcaactgataagacgagccgattggccgatgctctttttaaaggaaacggccatattgaaacgatctgcttcatccatcaggcaaaagacggcgccgattattacgccgccgcatcggggcgaaacctttacggcagagtgcgggagtctcttcaaaacaaacagatactcggggtcgtcgacataaccgcatatgacgcggaatatgaacggcaggaagagatagaacacggaaagcttgcctttttacagcaggctcttgaatcattccgtcatagcggcgctgtgttcagccaagtgacacaccgcctccagcctttcaaggaaagtaaacctctgatgcaaggggcgaaaacggcggggctgtaccggatgctgggcgctgagtatgccaacattcattcttttacgatagatagcgattgtgcgattgagcatacagaagaattaagcagacagattgagactgaatttttacagccgcgggccaaaagcggcagtgaatgctgctacaggctgaatcgccgttatgtgccgtttctaaagcagggtatgaatgtttcggcggcgcctgagctttcctattcgtctgatgatgtgctgttaataacgggcggatcgcgcggaatcggcgcaattgcggcggagcatgccgtttcacgcggctgcaggaaactggtcatcatgggtcgggagccgcttcctgattcctcagagtgggcagacatgaaaaaggacggcattctcccggaaaaagccgagcggatgcagaggttagccgagcggggcgcggagatccgttattacagcgtttctcttacggatcaaaaggggctccggaacatgacggacggcatccgcggcacgatggggccgattaccggcgtttttcattgtgcgggtgcaatgggagaacaccccgctttttataacaaaaccgaaactgaaatcgaaagcgtttgcacgccgaaagtaacagggcttcgcggtctctttgaagccgttcagaatgagccgctgtcgttttttattttgttctcatccgtttcgagcctgatcccttcgcttgctgcggggcaaagtgactacgcgatggctaattcatttatggactcttttgcaaatcatcaagcaggtaaaggaaacgtgtttgttaaagccgttcaatggcccgtctggaaagaaaccggcatggctgaaggcctgccggaaacacctgcttatcaaaaatcaggactttccaggctgtctgccgaagacggactgaagtttttagattacatcattttaaacggacaaagctgcggaattccttgtgttcccgaagacagtgaggctgattttggtgatcttctgaaggtgaagaaatctgaagctcccatgaaaaaaagcactgccggtgaccaaaaggtgaaggatatgattcgtcaatgggtgcgcaccgttttcagcgaagaactgaaaatgacggatgagcagataaaagatgatatgccgtttgatgaatacgggattgactcaatactctttgcggaattggttcaatcattgcaaaaacggatcagcataaagttaacaccgtccttaatgcttcaatatcaaacgattacagaaatggttgactatttcgcagtgcatcatgaagccgattttgtgacaaaagaaaatggtttcgttcaagacagggacgtagagcctgatttaatcgctgacgctgaagagagaacattcatggagccgaaagcggatactgaagacgatattgccgtcgtcggcatgtcctgccgttttccgggggcgggcggaacggatgctttttgggagctgctgatgaagggaaacaccgccatccggcctgtccccgcaacgcgctggcatgcaacagcaaatgcaaaggattatgcggggtggattgatgatatcgacatgtttgatgcgggctttttcggcatctctgaaaaagacgcggcaattatggacccgcaggcgcggatcatattagaagaagcggttcattccgtttatgatgccgggtacggccaaaaggatttatcgggccggaaagtcggcgtgtacatcggcggcagggcgcagccttcagccggtatggaacatattttgcaggcgcctaacccgattttgggggcggggcaaaactatttggcggccaacatttcacgatttttgaatgtcacagggccgagccttgtcgtggatacagcatgttcttcagggctgatcgggctgtcctttgcaaaagacgcccttttggccggaaggattgacgcggccttagtcggttcggtgagtctgctcttatctccgtccgcgcaccggttattcggagcgcgccatattttaaatgagaacggcgtgtttcatatattcgaccgtgaatcagcgggagaagtgctcggagaaggagcgggggcggtttttatcaaacgattgagcgatgcggtgcgggacggagaccgtatttacggcgtcataaaagccgtctcggtaaacaatgacggccggacgctcggtcccggttcaccgaatataagagcgcagagagacgccattcaaactgcgcttgacatggcggaaaagtcgcccgaagacattggatatatagaagtgaacggaggcggttccccaatcgttgattcggtggaaatcaaggcgctctcagatgtctatcagctgaaccggaaaacgcttctgccctgccggatcggatcggtgaaaccgaatgtggggcatttgcttctgtcttcaggtcttgcgggcttcatccgatgtgtgctgagcgtctatcataagcggattccgcctttcttatcagcgcgtgagccatttgaacattatgactttgaagcgtcgcgtattcattttaatcgtgaacccgttgattggcattcagagaagaaaccccgcgtcgcagctcagagttcatttcctgacggcgggacaaatgctcatatcctcgttgaagaatacagaggtgaaaggcagcgggaacatcaccgggcgcctcagccgccggaattcagaaaaaaacactacccgcttttgggcggctggaacagcacggagaatgaagcggaaaaaacaagtaatgaaaaaacagacattgcggatcttttaaagaaatatgagaaaaaagcagagacaagcactgcacctgcagactcgttttggcaggtgacaacgtgacgtttttaaaaggggacgaaccatgaaaaaaacagtgaatctgcgcctgacggcagaacatcccattatgaaaaaccatcttgttcacggagaatctgtcatgcccggtctggcctatattgatatgctgtatcagctggcaaagcaaagccttgatctttcattccgttccatctgtctgaaacgggtgaccatttatcatcctttatcagtgaaacggtcagagcggcttgatgtgagtgtcatattcagtaaagaaaaggagttctggactgcctcgatttgcggggcggattccgggacggttttcttatcagcggaggtgcatgaaggggttttctcatcagataagcgccttgacgcggaagagaaaaaacaagttgcgcttccatcagtctccttgcatacggtttacgaagacgcgagaagccgcggactgtcgcatgacgggctgatgaagccggagggagagatctatgcaaatgaagaggaatgtttccttgatattcggcagtctgattcatgccaggaaaatctccccggcgctctctttcatcccgcgctgatggacggtgccgccatggcctccggcgtattgcagacagctgcaggcgccggtttgtttttaccgatttattatgattcgtttagtgccgctgaaaccgttacggagcgctgttacgcggtgatttcgaaaaaatccggcatgccttctgaaatggtgaaaatggatattgacttttacaacctcagcggtgcgcatattgcttcactgctcggcctgacagccaaaaaggtgcggacagaccggcagctgataccaggcgttcagcagatggaggaaaccttataccgcattttctcaacatacgtaggccgtcctgtcacaagaaatgatgcgcacaccgtattttttgaattaggccttgaatcgtcacagcttctggccattattaaagacatcgaaggggcgtttgatctgcggctgaatccgactcttttatttgagtgcagcagcatatccgaactgcttgaagacataaaaacaaaaggaacagaagaatcttccggccttgtcgcggatgcagcaccggtctctgaaacgcaatcagtcagtcagacatttactttctatgaacatgaagcattccttcaggatcatctggttttcggcaaaccggcactgatgggtgtagtgtatccgtgtctggtgcttgaagcgtccggagcgtctcattccggcacgtatcccgccgagctgaaagatatccgctttacgggcgggcccgtcacgctggagccgggagaggccgcacagattgacatttcatttgcggcagaaaagaatgccgaacgctttaccgcaagctgcactgtttccggtaaagaaagccggaagacgtgtgccgaaggagaaataagcagaggtatagagacacccgtaaaaaaatcgtatgacgttgaacaaatgaaggcgcatgcacaaaaggtagcaccggatgttatttcccgtctgtacgattcggttgccggcttcacgataggcccgatgctgaaaacggtaacggcgggatacaaaatgagtgagagctcctttttattgcagctggacttatcaggaaaaaaagaaaaaggcgatctgcgtcactttgcatttgacccgcttatattgaattcttgttatatgtcgctcggtgaagaagaattgcagctgaaaaagcggattcacgtcccgctcatgattgagaggctgacgctttacggaccagtcatgtctgataccgcctatgtggtgaatacaatcaaacataaaaaagacgggtttctctcatttgatgccgcagtcctcagtcataccggggaacagctggcggaattgaaaaacgcgtctgtgaaagaagtgcttcagccaaatcggcttgaaaatgcgtcttttgccccgtccgggaatcaaagccgtcagaaaacgaaaggaaaaccgctggatattgccattgtcgggatttccggcaagtatccgcaggccgatgatatcaatgcgttttgggaaaatctcaaacaaggaaaggattgtattaccgaaattccgaaagaccgctggaaatgggaacattacttttccgaggaccggacggcgccgggagcgatctacagcaaatggggcggattcattgacgggatcgccgattttgatcctgagttctttaagatttccccccgtgaagcggaacaccttgatcctcaggaacggctgtttttaatgcatgcgtggatggccatggaggatgcgggatatacgaggatatcacctgaactgggccgtcaggtaggtgtgtatgccggtgtcatgtatcaggaatacccgctattcgcggctgaagcgggagtgaaaggacggcatatcgggctccccggcgggatttcatccattgctaaccgtgtctcctatttttgtgattttcaagggccgagcatttcggtcgatacgatgtgttcgggttcgctgacttcattgtacatggcgtgccgggatctgcgggatcatcggattcgcgcggcgcttgccggcggagtgaatctcaccgttcatcctaacaagtacttcatgctgagccaggggcagttcatctcatctaaaggacactgcgggagtttcggcgccgggggtgacggctatattccgtcagaaggggtcggggtgctgcttcttaaacgtttagaagacgccgtacaagacggagatcggatttacggcgtcattaagggagctgccattaatcacggcggaagagcgagcggttacaccgtaccgaaccccaaggcgcaaagcgaagtcatttctcaagctttacaggaggcgggggtatctccgggccagatcagctatgtggaagcgcacgggacagggacgaaattaggcgatccgattgaaatccgggctttaaccgatgcattcggtgatgttcctgaaacatgtctcatcgggtctgtcaaatcaaatatcggacatggggaatctgcagcgggcatcgccgctgtcacaaaagtgctgctgcagatgaagcacaaacaaatcgccccatctttgcatgcggatgttttaaatccgaatatccaatttgacgaagggccgttttccgtctgccgggaattaacagattggaaacggatttcagcagacggagcagaacagccgctcagggcgggggtcagcagctttggggcgggcggttctaacgcgcatatcattattgaagaatatgaggctcctgtcaaacaagcaatcagcagccaagagccggctgtcattctgctgtctgcgaaaaatggggagcgtctgacagaatacgcggagcgccttcttgcttttcttcaaaagaagcatacggataagccggacttatttgatgtcgcatacactttacaagcggggcgggaagcgatggatgagcggctggctttcattgcggactctcttaaggagctggaggacaagctcagatcgtacttggaaaatgaaaacgcaccgcatctttacagggggcgggcgaagcgaaatcatgagacagtggctgtgtttgaatctgatgaagatttgcaagaagccatggtcaaatggctgaaaaagagaaagtacggtcatttgctgaacatgtgggtgcagggagtcgatgtggactggaacttgttatattcgggacaaaaaccccggagaatcagccttcccgcctatccgtttgcaaaggtcagatgctggattcaagatgaagccgaggcggtttcaaaacggaatgacggcaaaacggtgatccatccgctgcttcatgaaaacacatccgatctgtgggagctgaaattcacctctgtttttaccggacgggaattctttttcactgaccacacagtcaatggggagaaggtgctcccgggagccgccgtgatcgaaatggccagggcggccgttgagcgtgccgcatacgctgtgccggacggacgtaaaggaatgtatttgaaagatctcatatggatgaggcctgtcgttcataaggggacggatgtagaagtccatatcagccttatccttaagggaaatgaagacattgaatttacgatttacagcctatcggaagaacccgggggagaacggattatatacagtaaaggcaccgcggtatcaggagagatagcagcggttccgtcagttcacttagagggctggctgtccggctgcagccaatcggttatgacgtctgatgaggtttatcaggctttccggcatgcgggtatgatatacgggccgagccatcaaggaattgatcagctgatgatcggagagaggggtgctgcagcccggctgtcgctgccggaatcggcagacagtaccgccgatcagtttgtcatccacccgagtcttttggatgccgcgtttcaggcgtcactgggtgccggttcagatactgccggagacactccgatgctgccgttttccctgcggcaggcagaaatatttcagccgactcagaaaacgatgtgggcgcttgtccgcaaacagagcgatcggtcagataacggagcgctgacgctggatattgatttatgtgatgaaaacggcgctgtttgtatgagattgacaggcttctcctgccgggctgtccggcagacaaaccaaaccgaaagcaaacggcaggaagttcagacggcgatgcttgcccctgtttgggacaaaactttcttttctctggaagaaaatcgagcggttgatcaggaacaattgctgatcatcggaaagccgggaaataccataaaggctgcggcaaaaatgtggccccgcgcccatctggcggagacgccggatcattcaagcgagcaaacattacgtgaattgacagccgggtatcaggatatccgccatttcttatggattgcgccggatcgtttcgcacccgcatccgtcagtcaggaaatgcttgatgagcaggagaatggggtgattcaatgtttccgtttcatcaaagcgctgctgtcactcgggtatggaaaccgaaacatcagctttacggcggtgacccggcagacacagtccgtgtatccgggtgatctgccgcagcctgagcatgcaggcgtacacggtttgatcggttcattggcaaaagaatatccgaactgggacatcaggctgattgatgcagaagaaggcagtgattcgtctgagatgaaaaacatctggcgccttcctccagatccggacggaaatgctgccgcgtaccgtaacggagcttggcacaagcaaaaaacagtccgggtgctgacaagttccgctccgcgtatgtcgtacagagaaggcggcgtttatgctgtcatcggcggagcgggcggcatcggagaagcatggagcaaatacatgatcacccgttacaaggcacggatgatatggatcggcaggcggccgaaggatcaggagattcagagcaaaatagacaggctggcgctatcaggccccgcgccgcattatatacaggctgatgctcaagatgccgcagcgcttaaagcggccgtccgttccgtaagagagcaatacggcaatataacgggagtcatccattccgcgataacgcttgccgacaaaagtatagcgaatatggatgaagcttctttcagaaacgcttattcagctaaggtgaatacgagcgtccgaatgatcgaagcttttaaggaagaaccgcttgattttgtgctgtttttctcatccgtaaattctttcacaaaaaatgccgggcaaagcaactatgcggcagggtgtacatttcaagacgcctttgcccgccatatcgcttccttgcttgattgtgaagtgaaagtcatgaattggggatattggggcagtctgggtgttgtatcagacccgtcttacagaaaacggatggaggcgtcagggatcggttctattgaacccgatgaagcaatggaggcgctggaagtcttactatcagaaccgttcagccaagcggcattcatcaaagctgctccgcacggcttagccgcgctgacggatcaagatgcaatatcggttgtatccggcccgaagccttcatttatggaaagcgtcaagcggcaaaatccggatcggaatgaacggcttgagactttaaaacgagaaatggagttgcgcatatgaacagccttctttgcaaactgctcttttaccaattacagtcaatcggttttttcagcgagcctgtcactacacctgcagcatccatgcggagcgccggcgtgatcggcacatacggcagatggctggaagaaagcttgaatctattaaaagaaaacggatatatcgcgtatgacggatacacggtcactcttctcacggatcagcgcccggacggccgcacagtctggaatgagtggaatacccataaacgcctgcttcccaatggggagcttgcgcaagctgaattggccgaggcgacgataaaagcgatgccttccattttaaaaggagaacgtccggctacggatatcgtatttcccgattcatcaatgcggctcgttgaaggtgtttataagcataatcctgtcgcggattattttaatgaagtgttagcagattccgcggccgcttacctgaaagcctatcttacagaacaccccgatgcccgcatcaggctgatagaagtaggggccgggacgggcggaacgagcgccatgctgtttacaaaactgaaaccatttgcaaaacagattgcggaatattgttatacggacgtttctaaagcttttttaatgcatgccgaacaggaatacggacctgatgtgccgtatttgacaacagccttgtttaatgcggaggagccttgcgaatcacaaaatatcaaaacgggtgtttacgatattgtcatcgccgccaatgtgcttcacgccacaaaaaatatcggtttgacactgcgccgtctgaaagcgctcctgaaatacaacgggatgattttgataaacgaaatcagcgatcgttctgtttttacccatttaaccttcgggctgcttgacggctggtggtcctatgaggatgctgagcttcggattccgggaagtcccggcttatatccaaaatcgtgggagcgtgtgctgcattcggaaggatacagagcggtttgtttccctgctgaaacggctcatgatttaggccagcagattatcgcagctgagagtgacggactcgtccggatgcaagggatcagagacggcagaaagccatacgccgccccggccgaagttttccgaaagcccgcacagcctgtttcccgcagccgcgcgccagaggagcatcaagctgttaaggctgatggggaatcggtcgtttcccatgtccgctctgtcatcaaaacaagtattgccgatgtattaaaaatgaaagaagaggatattcaggaagaactgaatttctctgaatacggcattgattccattttggccgtcaatgtgattaacgagattaataagcgattgaatcttacactgcagacaacgattttatttgattactatcatgtgaaactgctgaccggttatatctcggcagaatatgaaaccatcatagcctcatctctggagaccgaaagagcgaaaatccgcccggcgcttcaggaagaacggtctgctgaaaaacctctgcagacggaaagaaaggaaaacggttatcagaaaccgaaacaagaacgtatgccgctttctttcgcaaagtccgatgactcgggaatgttccgggttgtgattgaccgtccgggcggcattgaagatctgacgattgcccgcagtgaagtgcccgagacaaaagatgacgaggttcaaatagccgtccgcgccttttctttaaacttcggagacttgctttgtgtcagagggctgtacccgacgatgccgccttatccgttcactccgggatttgaagcaagcggcgtcgtgatcaagacagggaggcatgtaacatccgtcattccaggtgatgaagtgattgtcggcatgggagaggaatttggatctcaggcgaatctcatcacatgtaaagaacatcaagtctatcataaaccggcccggctgacctttgaagaagcatgcgctcttcccaccgtagcggtgaccatgatagacgccttccggaaagccggacttaaaaaaggcgaaaaaatattaattcagaccgcgacgggaggaacggggctgatcgcggtgcaaatggcccggcatatcggcgcggaaatatatgccacggccggatcacagaaaaaaattgagtatttgcattcgctcggggtccgcaataccatttgctatttagaagaagattttgaaacggaaatcatgcgaatgaccggcggccggggggtggatgttgtcattaataccctggccggtgatgccatgcaaaaaggaatgaattgcctggcgccgggcggaagatatatcgaaattgccatgactgcgctgaaatccgctaaatcagtcgacttgtccgtccttcataacaatcaatcgtttcacagcgtggatttgcggaagctgtcccttcaaaatccggaccaggtcaaggactatcaattggaactgcagcggctggcggaagagggagtcattcagcctgtcatctcaaaaatcttttcctttgaagacataaaagaggcgtatcactgtctggatgaccgcggaaatatcgggaaaatcgtcatcagcgtttctgagccgtatcaaatgacgtaccgccccgaacaaaaggatccggccgatacagtaaaatcagcagctgtgttacatgaaaaagaaccgatcgcgattatcgggatgagcgggcggtttgctgaatcggagaatctccatgagttttgggaacacttagccgccggacgggatctgattaaaaaagcagacagatgggatgtctctgacagccaatgccagtatggcagttttatagaggacattgaatgttttgaccccgttttctttcatatatcgggacgtgaagcgacctatatggaccctcagcagcggctgtttttggaagaatcatggaaagcgcttgaagatgcgggatatgcgggagactcggtaagaggccgggaatgcggcgtgtatgccggctcctgcggcggagattaccaggccatttttaaacagcaggggcccgcgcaggctttttggggcaatcacaattccgtcactccggcaaggatcgcctatcaccttaatttacaagggccggcgatcactgttgatacagcatgttccagttcactgacagccattcatttggcatgtcaggggctctggacgaaagaaacggaaatggcggtggcgggcggggttttcattcaatccactcccgctttttatcagtcgtcaaataaggcgaatatgctgtcaccgaccggacgctgccatacgtttgatcaaagcgcggacgggttcgtgcctggtgaaggcgtgggagcggtggtgctgaaacgtcttagcgacgccgttagtgacggagatcatgtgtacggcgtcataaaaggatctgcaatgaatcaggacggcgctacaaacggaatcaccgctccaagcgcgctttctcaagaacgattggaacgtcatgtctatgatactttccacattgatccggaaaccattcaaatggtggaagctcacggaacgggcactgcactgggcgacccgatcgaattcggcgccttaacgcgcgctttccgccgctatacggataaaaaaggatattgcgccatcggctctgtgaaaaccaatctcggacatgccgctgcggccgcggggatggccggactgtttaaaatcctgctgtcgctgaagcatcggcagattccggcttccctgcattttcaccaagccaatcagcatattcaatttgcggacagcccgttttttgtgaatgaaaagctgatacagtggaaacggaatccggatgcaccgcgcagagccgctatcagttcattcggattcagcggaacaaatgcccatcttgttattgaagaggcgccgcaaaccgtgcgccggtcgccggcaaaaccggcctgcctcattcctttatctgcgcggacggagcgtcagctggaaattcaggcagaacgcctgctggattcactcagcaagaacaaagacagcgatctgggaaatataagttatacgctcctgctcggcagaaagcatttacatcaccggtttgcctgtatcgtaagcagtgcggacgaactgaagcgggtattatcggagtggcttgtaaaaagagagcttccgggtgtgtttgtgtccaatttgaaggatcagaagccggcagaagaagccggaatgaaaacattcggaatggaatgcattgaacagtgccgctcggcggcttcgcccgcgcagtacagagaaagcctggcacatatcgctgaccttttttgcagagggtatgatcttccttttacacggctttttgacggagggcaatattataaaacgccgcttcctgcctacccgtttttaaaagaaaggtattgggcggctgatgtaaatagttctttaccaggccaagccatgaaaaagtctgaaacgcaaaccgttctcccgtcttcgccgcagcctgaacatgaagggctgatttctctgactcctttaactgagatcgaaatgagagcgtttgaaccggagacattgcaaaagccaatcgtgttacagcctttggattgtactgtttctgtccagcagccagaaaaagccgtttccgaagacaatagaacattgcttgaagaattgaggacaagcctggcagatattttatttttgtcaccggaagatattgatgctgatgagcctttcatcgacatgggtcttgactccattatcggggttgaatggatacaaacagtaaataaaacgtaccacactgagattactgccaataaggtgtatgaacacccgacgcttgaagagcttgcggaatatatagcgggacaaataaagaaacccgagtatgctgaagcggaggaaacagcggtacgtccgcaaatcccggaagcagaaactccccttgccggcatctctgacggcactttgcgcaaagagctcaaagaaagccttgcggacatcctgtttctgaagccggaagatattgatgagcatgaggcattcattgagatggggctggattctattatcggtgtggaatgggttcagtccattactaagacctatcaagcgtctattacggcaaatctggtctatgaatatccgacaatcgcaacattagccgggtatctgaccggttctgtccaaaaagacaccgaggaagtacatggggaacatacgaaacaaaacgatatatcagaagagacagatgatcaagaaccgcccgagctgatctgtcttaacccaaatggaaagggaagaccgattttctggtttcattccgcgctgggggcagtggagctgtaccagcctgttgccgaacggaccgggcgtcctttttacggaattcaggcaagagggtggatgacagaccgggaaccgatccgcggcattaaaaaaatggccgaatattacgttaagctcatacgtaccgtgcagccccggggtccttacgatgtaggcggctattcattagggggcatgctcgcttatgaagtcacccggcaattgcagctggctggagaaaccgttgagtcaatcgtcatgctcgactcctttgacgcggcgggtgcgcgggaaataaacattcctgatgaattatttgataaaaatatgatgctgcagacggtgaacatggctttatttgcaccgatttatcaacatccggaacgcatttctgaaaccttgattcaccgtgatgaactagatgccgatcttcatgaagacatatttttagagcaattaatcgcaaaagccaaacagcgggggttaacgaagacggacgcgttggtgaaaaatctgatcaggcagaatataaatgttcaggacgcttacgaaatcactgattacgaactcctgccgcttccggatccgaacggggtgacatgctattatttccgaaataaaaacggtattttcttgggtgagcttgatccgtattttacaatcagggctgatattttatccgctgatttcgtcaactattggagccagtgggaagagcatatgacaaacatcgccatcatggatgtggcggtatccaatcatatgacgttattggctgaagacagcgcagccgaaacgatttctgaattttgcggcgttttatattcggcagacggaatgacagaatacagctttctgcagctgcaggaaaagatactgaacgtgcatggtgagatgctgaagcagcccgccaaaacaagaccgtaaattcacatatccgcccgccgggtttactcgtaagctttggcgggtcatttcaaatcttgaacacatcttggaggaatgaaaatgaccagtttaacaaaaatcagacagcagcagccgtacaagtggtaccaaacgatgagagaaacctctcccgttcattacaatgaaaaggaagattgctgggaaatcttcacctatgatgaagtgaagcgggtgatttctgactacagtcatttttcttccgatcataaatacttaagtgcggacaaacaggaaaaaatgatccggcatattaacaaagacagccttttgaaaatggacccgcccgaacacaccgtcttcagaaaattggtcaatcagccgttcatgccgaaatcggttgagtctcttgcaccgcgtatagccgctatcgctgatgacctgcttcaggccgtccgttcaaaagacaggatggacattattgaagattacgcatttccgcttccgattatcgtgatcgcagagcttttaggatttcctccgaaagacagggatatctttaaaagctgggtcgaccaaagccagaatgtaaaagatgaaaagaaaatgaatgaagtgcaaaagcagatgatcggatacttcatgcagtttattttacagcggagaaaacagccgcaaaatgatttaatcagccatttaatttcagctgatttagacggagagccgctgtcagacaagcaattaatcggtttttgcggcttgttgatcgtcgcggggcacgtaacgacggagaatgtgatcggaaattcatttctcagtctcaaggagtttccgcatattctgccccggctgcttgaaaataaggcgctccttcctgactttattgaggaagtcatccgcctcagaccttccattcagcgggtaacccgctacaccgcggttgagagcgagattggcggaaaaacgattccggccggagaaaaagtgtatgcgtggattggatcggcgaacagagatgaaaagaagtttgaaaatcccgatcagattgacttgggacgaaagccgaatcagcatctgtcattcggtcagggcagccattattgcttaggagcgccgctggcccggcttgaagcgaaaatcgcgctttcccacttttttgaacagatgcccgcatggcgttttactgaggatcaagagccgaatctggttccgagccctgtatttcacggcgttgacaggctgcttgttgagttttgagcgaaaaaataaaagaggcttcgcgggaagcctctttactctgggggcttggagaaatgaatgtaggaatcgaagcaatgaacgtgtttggcggaaccgcgtatgtagacgtcatggagcttgcggaacatcggaacttggataaaaaaaggtttgagaacctgctgatgaaagaaaaagtggtggcgcttccgtttgaagatccgattacgttcgccgtaaatgccgcaaaaccaattatcgactctctgtcagaagaggaacggaatcaggttgaaatggtcatcacctgtacggaatccgggattgattttggcaaatccatcagtacatacgtccatgattatttgcagctgaagcggaattgccggttatttgaggtgaaacaggcttgctattctttaacggccgggtttcaaatgggcgtgaatttcatcttatcgcaaacatcgccgggagcgaaagcgctcatcatcggaacggatatttcccgctttttagtggctgaaggcggtgacgcgttgacggaggaatggtcctatgccgaaccgagtgcgggggcgggagctgtggcgcttttagtcagcagcacccctcatgtctttttgcttgatcaaggcgcaagcgggtattacgggtatgaagtcatggatacctgccgcccgattccggatagtgaagcgggggatgctgatctgtcgctcatgtcttatttggactgctgtgaaaaatcatttcaggaataccgaaagcgtgtgagcggggcggattataagaatacatttcaatacctttcttttcatactccgtttggcggaatggtaaaaggagcgcatcggacgatgatgagaaaattggcaaaggctaagccgcaagacattgaagcggattttcagcaacgcgtgctgcctgggattcaatactgtcagcgcgtcggcaacatcatgggggccaccgtatttttatctcttgccagcacgattgataacggctcttttgaaacgccgaaacgcgtcggctgtttttcatacggttcgggctgctgctctgaattttacagcggtgtcgttatgccgcaaagccgtacgcggcagaatcaatttcagatcagccggcatttggatgaacgcgtccgtttatcgatggctgattatgaccggctgctccaagacagcggcatcgtaaaattcggcacaagaaatgccgcgcccgcagcagacatcccgaatgcgcatcaaggaaaaacgcgattggtgctgactgaaataaaagagtttcacagaaagtatgaatggacgacttaatatcagaaacactcagagccggaaaggcttgagtatttttaaagaaacggagaataaacatgaatccaatgattgatgtacaggaaacagaaccgggcattgtgcaggtcacaatgcaggatacggccgggaaaaacgggctgtcagaagagtttgtcagagagctgcaccgggtattccgagacatcaatgcccatccgtcctataaaaccgtccttctgacgggttacggaaattatttctgcacgggaggaacgcaggaggggcttttgaccattcagagcggaaagcttcaatttacagatttaaagcttcacagtcttttattggattgcaggattcccgtgatttccgtcatgcaggggcatgcgatcggagccggctttacgatcggtctgagcgcggatttcgtgattttaagcagagagagtttttattcttgtaattatatgaagtacggatttacaccgggaatgggcgcgacgtatattgtgcctgaaaaactgggaattgtcctcggggaagaaatgctgtttactgccgcgaatttcagcggcgccgctctggaaaaacggggagttccgtttgaagtgctgccgaaaaaagatgtccttcaaagaggccgcgaattggcccggctgctggcggataaaccgagagcctcactggttgcgctgaaaaccaatgtgaccgcacggatcaaaagagagctgacaaaagcggttgaggaagaggtgaacatgcacgaagccacattccatcttcctgaagtaaaagagagaatcagccgcttatacggcagttaaacagaatgaaaaaagcatgggaagccccatgctttatcactggtccgtcttttgcagaacggagcctgcgaattgttctttaatttcggcgctccgggctgcggtttctgcgatgcagtgcatgatggcttcttcaaagcggcgctcttctaatgcgcgaaggcctgcttcagtcgtgccgcccgggcttgtgatttccttgcgcaggcgttcaggccgtttgctgcttgttctgagcatttccgtcgccccggccatggtttgtaaaatcagctcttttgccgtttcttccggcaggccggcttgaagggcggccttttccattgcttcgacataccggtacacataggcgggaccgcttccggcaatggcagtgacggcatcaaggtgtttttcttcaaagcgcgtcgcttctccgatggtttccagaagctcttttgccatccggatttcagcttcactcgcctcggagcttgcggaaaaaccggtcgccgattgctgaatggccgcggatgtattcggcatcgcccggatgatggtgagctttctgccgaaatattgctgaatcgtgtgaatcgtcagccctgcgatgacagaaatcacaagctgatctttcacgtattcgcgaatgttctcaatgctttctgccgcatctttcggtttaaaggcgagaacgagaatgtcggtattgctgaaaaactcttctttatcccggcacggttttactccgtacgttttttggagctcttcaagccggctgtcatttgaccggtttgtcatatatatatgtccgggggctgtcattccgctttgcagcagtccgttcaccattgcttccgccattgatccggccccgataaaaccgattttcttcatataaatcctccttcttctcaaaacacaaaaaaaccttcccgtcaaaaaggacgaaaaggtttcgcggtaccaccttacattagcacgaatcagccgtgctcagctcaaatcccgtaacgaggggatacgtttaggttttcctaaccgctctgagggcaggttctgtaaacaagagggccgcaatgtctttcagccggggacattgctctctgctgccgttgtttatatactagttcctcgtcatcgcgttccgtgttttctagtttgttgttcattatgctatgcgcaagaacgggatgtcaatctttttttccgatatgcggcaataatgacacagtgaaaagaaaacgctaaaatatgattattcaggaatgaaaagaacgaaggagcgtaaacatggcagcgagaaagatcattccgatacgtgtgccgactccgtttgcagtcggcgacgttatcgtttatttagtaaaagatgaagccctaacccttattgattgcggcccgaatacaaaggaagcggctgaatcgctctcattgcagcttaaggaacacggggtttctgcggcggatatagaacaggtggtgctcactcatcatcacgcagatcattcaggtctgctgcaccttttttccgacgatgcggaagtgatcgggcatccgctgaatgacaggtacattactcaggatcagtcgtatatcgcccggcaggaggacttttttctgtcgcttatgactgaaatggacgttcccctgacgcctgaagacatacataaaacagttaagctgtcatacttattttctgcaaaccgtccgttaacgaaaacagtgagggaaggcggaaaaattgacgggcttaacggctggacggtgctcgaaatcccgggtcatgccgcttctcacattgcgctctaccatgaaaaaagcggtgaaatgttcagcggcgatctgcttttgtccaacagctccaccaatccgattctggaagctccagaaaaggggggcgtgcgcgcggccccgatgctcgactacttgaactcaatgaagcggctgtatgacgtaaacccgtcctttttatatccgggacacggcgatctgctgacagacgtaaagcctgcttttgacaggcggcttgaaaaacagagaaaccggtcggaatatgtgctgcgcctgttgtcagaggaaacgctgacggctttccaggtatgccggcggctgtttccggctgtgtatgaaaatgaattgtttttaacgatgtcagaaacgatcggccatcttgacgtgctggccgccgaagggaaggctgaatcctttcagtcggggaacactctgaagtttaaagctgtgaaggggtgaaggaaatgggcagattaacggataagcggatttggatcaccggagcatccggcggactcggagaacggcttgcatattcctgcgcggcagaaggggctcatgtttttttatccgccaggcgggaggaccgcttgcaggaagtgaaaaagacgattaccgcgcgcggcggacagtgtgatgtcgttccgtttgacgtccggcatgcagaagaggctgaaaacgtaaggcgtttgatcggtcatgttgacgtattaatcaacaacgccggcttcggcatttttgaaacggccgctgattcatctttggatgatatgaaggcaatgtttgaagtcaacgtcttcggattaatcgcctgtacgaaggcctgtcttcctgtgatgcttcatgcgaaaagcggccatattatcaatatcgcctcacaggccggcaaattggcgacgccgaaatcaagcctttattccgcaacgaagcacgccgtgttagggtattccaatgcgctgcggcttgagctggccggtacgggtgtagccgtgacaacggttaatcccggtccgattaaaacagacttctttacaattgcagataaagagggcggttatgtgaaaagcgtcggcagatggatgcttgatgccgaccatgtggcagagcgcattacatccgtgattctgacggataaacgggaaatgaatcttccgcgatggatgagcctcgggacgaagctgtatcagcttttcccatcgtttacagaaaaactggccggccgcgcattaaagaaaaagtaacaagggggaaaaaggaatgtccgaccgggatatacacaaggcattgatggcagagcctttagtcaggcaaatggcggaggcgcgtgaagtattttggatcaatccgcataaaaccgatgatccagtaaagcatggcgctgaatggaaaaaggagattgccgaagcggaagaaaggctgcgccggtttgcgccttatatcgcgtcggcttttccggagacggaagcggagggaggcctcattgaatctccgcttgtcttgattaatgaaatgaagaagcatctggaacacagcgccgctcaggctttccccgggcgtctgcttttgaaatgcgacgacgaacttccgatttccggttccattaaagcgcgcggcgggatttacgaagtgctgaagcatgccgaagatctcgcggtaaaagcgggaatgctctcagcagacgacgattacagcatattgactgaagaacggtttaccgcttttttctcaaaatactctatagccgtcggctctacgggcaatttaggtctgagtatcggcataatcggcgcgaagctcggcttttgtgtgaccgttcatatgtccagtgacgcaaagcagtggaaaaaggagctgctccgggaaaagggggttcgcgtcatcgaatatgaagcagactacagtctggctgtcaaagaggggcgcatgcaggcgaagcaggacccttattgttattttattgatgatgagcattcccgggatctgtttttggggtatgccgttgcgggaagccgtgtgaaaaagcagctcgaccaaatgaacataaagcctgatgcagatgaaccgcttttcgtttatttgccgtgcggggtcggaggaggcccgggcggcgtcgcgcttgcgctaaagctgatctatggcgagcatgtccatatttttttcggtgagccgacgcattcaccgtgtatgctgttaggactgttttccggcttgcatgacggaatcagcgtgcaggatatcggtcttgataatcaaacggccgccgacggactcgcggtgggaaggccgtccggactggccggccctctgatggagcctataatcagcggctgttataccgccgatgacggcacgcttttttcgctgctttatcaattaagggcggccgagaataagagccttgaaccctctgcactcgccggactggccggggccgtcaaggtcgttcagaccgaagccggaaaccgttatataaaagagcgggggcttgagatggaaaatgccgtgcaccttgtgtggagcaccggcggaagcatggttccggaggaggaaatggaagagtacagccggatcggttcctcatttttgaaaaaaatgggcagacagtgaagcggttttccgttacaatctttgtaagcgtttgtttttttatcggaaagccatacagagagattggtgtgaattgtgaaaagtaaagaattgaacttacatacattgtatacgcagcacagccgcgagtcgtgggccggattcggcggccatctttccattgccgtttcagaggaagaagccaaggcggtagaggggctgaatgactacctgtcggtggaagaagtagaaacgatctacattccgcttgtgcgccttctccatcttcatgtcacgtctgccgcaagacggaatcagcatgtcaatgtgtttctgaagcatccgcattcagcgaaaatcccgtttatcatcggaatcgcgggcagcgtcgccgtcggcaaaagcacgacggcgagaattttgcaaaagcttctttcccgtctgccggacaggccgaaggtgagcctggtgacaaccgacggtttcttgtatccgacggcggaattaaaaaggaaaaaccttctgtccagaaagggattcccggaaagctacgacgtgaaagcgctgcttgagtttctgaacgatataaagtcggggaaagagagagtggaggcgcccgtatattcccatcttacgtatgacagggaagagggcgccgtcgaggttgtcgaaggtgcggatatcgttattatcgaaggaatcaatgtcctgcagtcgccgaccttagaggacgacagggaagatccgcggatttttgtatcggatttctttgatttttcgatctatgtggatgccgaagaaagccggattttcacgtggtatttggagcgtttccgcctcttaagagaaaccgcttttcaggatccggcttcttattttcataaatttaaggatttgtctgatgcagaagcggataccatggccgcctccatttgggagagcgtcaaccgtccgaatctgtatgaaaatatcctgccgacaaaattcagatcggatttgattttgagaaaaggtgatggccataaagttgaagaggtgctggtaaggcgggtgtgatgggaggaggaagcgaatattatgatgcatcatattgagttgtatgtatctgacttgaaagcctccgcccggttttggggatggtttttaggtgagctcggttatagagaatttcaaaattgggactccggcatcagctggaaaaacgcaggattttatgttgtgcttgtacagacagaggagcgttttttaacaccggagtaccacagatgccgggtcgggctgaaccatctggcttttcatgctgcatcaagagagcaggttgacgagatgacagaaaagctgcttgccagaggatgccccgtgctttacagggaccgccatccatatgcaggcggaagcacgcattacgccgtatacacggaggacccggatcggataaaagtggagctcgttgcgcctgcttctgaatgaactataacttttcgtttttttcttcgcgcagcgcgtcgagtttcttttcgattctgtccaattgtatgcggcgcttgttcaagcttctgaatacgtatatcacggcaaacaggaaaaatgcggctgcaataaatgaaatcaattgaaaaatgacatcaccgatgttcatcttttttacctccgtgtgcggcgggtttcttcagcccgccgttttttcattttgaccgatgtgaagacatgggggatgaatcatttctctcctagctttgttttttttctgagaatgaatagtttctgcatgtggcttatgaccacttttgcggccgcatatcccggaatggccagaagcatcccggcaattcctgagaatttgccggcggcaagcagaagaaaaataatggtcagcgggtgaatgtccagcttccgtcccataatttgcggggaaatcagctggctttcaagctgctgtacaatgacgacgaccgtaatcaccagcaccgcctcggtcggtgaatcgaacaatccgacaatgactccgggaaatgtgccgatccaaggcccgataaacggaatcaggtttgtcaccatggcgaacgcgcccagaacgagcggataatcgagcccgattataaaatagccgattgtgacgagtacgccgacacaaaaactgacgagcagctgtccttgtatgtatgaactgagagcttcatccatgtcctgaaggatttgttttccttcttttttatgtttttccggaagaagccgcagcagtcgccggggggctttgtttccttcttttaacatgtaatacagcgcaaacggaataatggcggcggtgatggcggcattggcagccgtaccggccaggctgctgagagaatcagcgattgaaccggaataatttgcggctttgtctgctaattttttaaaggaatccccatgctgaagccgggaaaaccatttgctgtcctggagatgcccgatccaattttcagcttttgcggaaagctccggaatatgatctgtgaaggctgtaaactgtttttgaacggcagggcccgccgtataaaggaagaggacaaaaaggccggctgttcccgcataaatcgctaaaatcgcgattccttcgggcagctttaatttcgcatgcagcagtctgacgagcgggcggcacaaatagtaaaggacgcccgataatacaatgggcggaaacaaggttttaaccgtaatcacaacaggctggaacaaaaagtctattaatgttccgagataaatgatgagaaataacagaagaacggcatagccgatcctgaaataaggcccgacaggcatatcctgcaccacgcaatctttaaaggtttactctcggacatttcccttatcgccgggtgcataaacgtccgtgtcaggaaaactgcccttgattggtgacgtaatcgtagataatatcttctacatgggcatggagatcctcatcgggttcttcattccttctttcttctaaagctttttttaaactctgtttttcataggggctcagcggatctgtcgacacattccgtccatactggcggagggcttgtcccagcattttttctataaattgatccatcatatattctcctattcttgtcattcatctttattctactaaatatcatgtgatcctcccactcttctatcatattttctgtcagggccgggttaggatttttattccaattcagctgagagaatacgatgaaacggcagcgttaacgcatcttcatcgtttatgatttttaaacgcttttcgtcatgcctcacttgttttacccagccccaaaagcggcgggggccgtgtgcggaagcgtaggtgaccgaaatggccctgtcttcttcaatcgacgccgcaatgatgcggttcatgtcgttcagttgctcttcgctcagttccggaggccggaattcccgttcttttcgttttttcgcaagcagctgctcccgatgttcgggcagcatcatccggcttgattcccacatgacattatacccgggtgttaatttgttcggattcatgtatatcacctcaaattatttgtaatgcccgccgattttttcagcccggtgaaaggcttggccggcctctgtcagtgaagcggcatggaggagcgacgcagggccgtaccgctcatgaatatcatccaatactttgccgagactgatctttttttcctgggcatcgaacaggctcagctgaacataatcacaaggctccagctgggaaagggagacgccggcgctgcggacgggcgcaccgttccaatgctctttgaagagcttgaccgccgttttaaaaatatccattccgaaattagtcggtgacaccagctttctctgtctgtgaaaacctgaagggaattcaaaatcagcgcctctgatgctgaccgaaaccgtatggccgatgtattgtttgaaacgggcgcggcgggccacttcttcgcttaactccagcagcacgactttgatatcctcaaagcggctgtagtctctcgggagggtcatgttatggccgatcgctttttgccggctgtgcgtgttgacggtgaccggagagggatcgatgccgcgggctgtccgctgaagcaattcgccgttaatgccccagcgttttttcagcaattcggcggggtgtccggcaagcccgccgattgtgctgatgcccatccgtcttaaatgatgctccatccgttttccgatgccgaataattttccgaccggcagcggccacagatcctgcctgatatttgacatatccaatctgtggatgccggatgcgttttttttggcaaaatggtcgcaagccatttttgcgagcgccttattcggcccgatgccgacacgggcataaatgccgaattcacgcataatcgcttgctgaatgcttttggcaattgtaaaaggatcaccgaacagccgcctgcttccggtcacgtcgagaaactgctcatcgatggagtagggttctacaagatcggtataccgttcaaacagttcggtaatcatgacggatacatcaatataccgctgcatccgcggacggacaataacggcgtcgggacatttggcctgcgcttcccacagccgttcggcattttttacgccgtatcgtttggcgagcggacaagccgcaagcacgacgccgctgcgtctttcgggatctcccgagacaatcacgggccggcttttgagatgaggcgcttccgctttttccacagacgcataaaacgattgcatatctacaagaagaatatcagccataaaaaaacctccgggaacatttgttctgtttttcattgtacccgaacaatgatcacgtttatactggtaaatcattccccggctggaagacgtgctgattcgttcgcttgaaaagaaatcatttacaattgcaaacaacccacatataattttttatattccaatgagaagagctgacattcattttgccggacgaaaaggagagtcaatcgataatggatattcgaacaattacctctgaagactatgaaatggttacgtctgttttgaatgattggtggggcggcaggcagatgaaagacaaactgccgcgcttgttttttgaacattttcaggacacaagctttatcacgtacgggccggagggaatgaccggttttttaatcggttttcagtcacaatcagaccctgagacagcctacattcatttttccggtgtgcatccggatttcagaaaaatgcaaattggaaaacagctctacgatcgatttatggagacggtgaaaaaaaggggctgcacaaaagtcaattgcgtgacggcacctgtcaataaagtatcaatcgcttatcatacaaaattaggctttgaagctgaaaaaggaaccaaaaccgtaaacggaatccctgtttttgcgaattatgacggtccgggagaagaccggattctgtttgtgaaatatatgtagagggggatgaatatgggttttttagctgacacgcccaaaccgccttattatgcggtcattttttcatcaataaagggaaaatatgatgaggaatatgaacatacggcagagcgcatgatgaatttggcaggcggacagccaggctttttaggcgcggaaagcgttcgggaggaagacggctgcggcatcacggtttcctactgggacagcctggaggcgattaaaaggtggaaagatcatactgaccaccaggcggcaaaacaaaaaggaaaaagcgcctggtatgaagcgtacgcggtccgcattacgaagacggagtcacagcggatgtttgcgtcaaaaggggcggaagattgattacatttttacagcatacacaagaacagaccgcgcgggaaattgcggcggttcagcgctgcgcttatcaaaaagaagccgagctgatcggctttttcggcattcccgccttgcatgaaacacccgatgatatacagcggtcacgggagacgtttgccggttacaaggaaaaagatcagcttgcaggcgtcatttcgtatgaaaaaaagggatatgaccttgtcatatgcaggctgacggtgcacccgtccggctttcgaaaaggaatcggacgggcgcttattcaatttgtgatagatcaaaaccgggacgcccaaaaaatagaggcggctaccgccagccaaaacgttccggcagtctctctctatttaaaaacaggtttcacagaagccggacagatagagacgccggaagggctgaccctctcgttttttcatctttatccgaagaggaaagcggaagttgttccgtacaagccggaatggaaagaaatatttgaaagagagaagacggacttgatccgaatcttcggcccagcacttcattctgtcagccacatcggcagcacctctatcccggggatggcagccaaacccgtcatcgatatactggcggaggttaaagatatttcggacgctgaccgattcagtccgcagctggaagcactcggctatgaggcgaaaggggaaaacgggatagagggccggcgtttctttcaaaaaggcggcaacaagcgcacacaccacgttcacatatacgaaacaggccatccggacgtgaagcgtcatctgctgttccgggattacctcaccgcaaagcctgaaaaagcggctcaatacatggaactgaaacggcacctcgctaagacgtacccatacgatatggcaaagtatagtgaagggaaaaatgactggatcaaggcggctgaacaagaggcaaaggtctgggagagcgggctgctgtaaagaaagcagaaacaatgcatacagcggctcggtatgctacaatggcgaaaatgaaaaacggaggatcatctatgcaaatacatgtgacggatgcggcgaaacacacacttcagcaggcaatggacgccaacccggggaaaaaagcgcagctccgctatgacgcagaaggctgcgggtgcgcggtgagcggcgtgccgaccatctggctggcggacgaattaacgggacaatgcgaagccattgaaaccaacggacttccgctttacatccagacctcacaaaaagtgttttttgacgaggaaatgacaatcgattacaatgaaaaggcaaaaacgctcgtcttaaaaagcccggcagagatgctgagcccgagaatgagcatattagtaaagcagggagaaacggaaagtgaatcaaaagctgaaagccattaaacagacggcacagcataaaacgtgggtatcctttctgaacaacaaccacccgtacagtctgctgcactggtccatcggaggcgctgaatccgttcagaaggatgtctggctgcttcaggatgagatgaccttcaaagcgcaggagtttacgacaatcgacctcgccattgattggatcggagaaaatatggacgggattaccgacgttttatgacgtgaaagcgaaagaaccagcatacgttctttcgcttttttacgtttgcgtcatggtatctaaaaaggtttgaacggctttacggtagctctccggatttttggtgtacgacatggcatgcccgcccgattcggccagatagagcatcttagggccgcgttttctgcggtgcagcaattcggaagaagcgggaggtatataatcatcttccttactgtgaataaacagcacgggctgccggattcggctgataaccgataaaggcgatacatcacggatacggtatccttctctcatccgcaaaaagaaatcagccaaaggcagaagcggccacggaggcagccggaactcccgcttcagcctgtaggcgagctgatcgcgaaagcttgcgaacggacagtccgcaatataaaaatcagcgccgttttcaatcctgatgcccgcccgcgtataataaggccgtcaccgctcccatcgattccccgtggatgccgatttgaccgccgtctccggttttgtgtctcacccaattcacggcttcttccaaatcatctttttcaaaatagccgtagctcgtcgttctgccgccgctttttccgtgcccgcggtggtcatatacgagcacattccatcctaaatctaaaaataaatccatgtatttcaatgaattgaacgaatttacggtaacgccgtgacaaataatcatggtgtttgccgtatgatgcggggcgacgtaaaagcctttgatctcatacccgtggcgtgacaggatgacagcctcttctttttccatggcctgaaaggaatcaaatctatcatgcccgtccgccgtttcttttttcatgatatcttcatccgtctttttcttcataaacataatcagattcgtaaaagcgaatccggcagccaaaaagactgcgcaagccgaaccgaacaccgccagccgttttttcacacaggcaccctcctttcatatgaaaaatccttcctccggcttttcaggaccgtgaacgttgccggcctccggcgctccgtggtacacttgcttcaccatattcagatacggggggcgtcatgatgaaaaagcagctgcctaaagaaaaacacagcttaaaagacgatctggaggaagatctgaaggccaggcttttgcaaatgaaaagtgagctgaaggaagaagacgagaaaaaacaggcgcagcaaaaggcggaacaaatcagaaaacgaaaagaaaaagaaaaacataaaagctttgaagagctgctgaatgaaagcagtctcgattggcacaaatataaataaaccggcatctgaaaaggtgccggttttatgatttaagaacgatgggattcgtatacgtcccgttttgtatggtattgcaaggctttgatttcctggctgcttaaacgccgggcctctgcagccgaacagttttctctcagctgctcaagtgagctggctccggtaatgacagaagcgacggcctgctgtgacagtaagtattgaagagaaagctccgtcatgctcaagtcaggtgcggcagcgctgatcgcttttttggtttcttccagttctgcaaaagaatatgttaaatagccgttctcttttacgcttgcggccgcttgatcaagcggtttttccgtaagaagccctttagcgacaggccctcttgcgactacgctgattccgttctcctctaaaaggggaagccactcctcgggacgccggtccagcaggctgtattgcatcataacgctggtgatatttgattttttcacatattctttaataacattcggacgaatcgaggaaataccgtaataccggatgacaccttcctgttttaagtcctcaaatgcttcgatcgtttcgtcaatatggtcttccatcgtgccgccatgcagctgataaaggtcgatatagtccgttttcagccggcgcaggctgtttttgaccgcttcttttatgtatcctttggaagcgtcccaatgccagccgtctttatcatcattccagcggtttccggctttcgtggctaaaatgatgtcgtgtctgcggtttttgacggcctccccgacaatttcctcatttctgccgaaatcataaagatcagcggtatctaaataattgattccaagctcgatcgcttcatccaaaatagacagcgctttagctttatccgtgcccagcgacatacagccgagcccgatttcgcttatttctaaatcagaatgtcccagtgtgcgttttctcatcgtttcgctcctttttatagtcttttattgaccgtaatataaaggcgcgaagttttcaactgttaaggcccggtgatccaatctccgacatagcggaatgtccgtccgtattctttcagtttagcccgcacttcccacgcctttccgaccaatacgatactcttatccttccggtacaccttcaatcgaaaagcacctccctctcatgcatgtatgataaaatatatgaggcataatagagagacagaacgggagatgacatgatgaaacatttagaagaaaaaacacttgcgaaaaaaaagctgtatgacgggaaagtcatagatctttacttagaggatgtagagctcccgaacggaaaaacaagcaagcgggaaatcgtcaaacatccgggagcggtggccgtacttgcggtgaccgaggaaggaaaaattattttggtgaaccagttcagaaagccgctggaacggacaatcgttgaaattccggccgggaagcttgaaaagggggaagagccggaacatacggcgttaagagagctcgaggaagaaacgggatatacggcggaaaccttgacgaaaatcaccgctttttatacatcacccgggtttgctgatgaaatcgtgcatctctttcttgcggaagggctttcgccgctggaagaaaaacgagagctggatgaggatgaatttgtcgaagtcatgcaggtcacgcttgaagaggccgtgaagctgattgaatcccgcagggtgtatgacgcaaaaacggcgtacgcgattcagtatctccagctgaaagcagcgctgaaggaaaaatgatgaaaaccatctatgcggatctgcatattcatatcggccgcacctatacgggaaaaccggtcaaaatcaccggggccaaaacgttgacgctgcaccggattttagaagaagccagtgaggggaagggaattgaactattgggcatcatcgactgccattccccggaagtcatagaagaaatcgagcgcggaattgatgaaggcggataccgtgagctgaaagaaggcggcatccggtatcggaatacgacgcttctgttgggcagtgagcttgaaatctatgatcacacatgccgcgggccgattcacgttctcgtctttatgccgtctcttgccgaaatgaagatgttttctgagtggcttgcaaaaaggcttaaaaatatccaactcagttcccagcgcatttatgaaaccggtttgaatcttcaaaggaaaacaaaggaattgggcgggctgtttattcccgcccatatgttcaccccgcataaaagcctgtacggaaaaggagtcatatcttctttgacagaagttttcgacccgtcgctcattgacgcggcggaactcgggttaagctgtgacaccgacatggcttcgcgggtaacagaacttgatccgtatacatttttaacaaattctgatgcgcattccttaggaaaaatcggcagagaatataatgaaatgcttcttaaagaagcgaatttcacggaattttcgctggctttaaaagggaaggacggaagaaaaatcacggcgaattacgggctgaacccgaagctcgggaagtattaccggacggcttgcgaccgctgcggcagcccggttgaaaaaggagcttccgcatgtccggagtgcggggggaaaacaatgacaaaaggggtcagtgaacggctggaggaactgagcggaccgaaaaaaagccgcatgccgcggccgccgtatattcatcaaatcccgctgcagttcattcccggggtcgggccgaaaacgttagaaaaactgaagcgggccttcgggacggagatggcgattcttcatcaggcgcaagaagaggaattggcgcgtgtcgtccagcctaaaatagcggctgtcattcataaagcgcgtaccgggcagctcgtccttgaggccgggggcggagggacgtacggcagaatcaagccgtaaaagccggtttttaacggagctcctcctgcaccttctttttcgtgcggacaaacgcaatcaattcgatgatttcatcctgattcagcggctgtccgtcaacggtcagtgtgccgcggccttgtgcggcgtttgttaattcgatggtctgggcaaacggctccgcctttttttcagtgcgcccgagtaaatcgtcgcacgtcgtgtcaaacagatcggcaagcgtgcccagcgcctcgaatgacggacgccggtatcctgattcatacccggcgtacgtgcttttggcgatgccgagacggtcagccgtatattgaagagaccaatttttcttttttctcagttcagttaaacgatctaaattcatattcaaaaccgctccttttcacttgagcaaattatatcatatcgatatgcaaaagtgtacgcgaattgaataataatcacttgattaatttcattcgtctgtctataatttgattaaaagtatgcgaaaagcgaatgcttaacacatcttgagaaatggatgaagaggtgcagggtatgaaaaaattattgctgttaacaaccggaggaacaatcgcctcagtcgaaggagaaaacgggcttgcacccggggtgaaagcagacgaattgttaacctacgtatcaaaacttgataacgattacacgatggaaacccattcgttaatgaacatcgacagcacaaatatgcagcctgaatactgggccgaaatcgcaaatgctgtcaaagaaaaatatgacgcatatgacgggttcgtcattacgcacgggacagacacaatggcttatacatcagcggcactgtcttatatgcttcagcatgctgataaaccgatcgtcattacgggttcgcaaatcccgattacatttcaaaaaaccgatgccaaaaaaaatatcacggacgcgatccgcttcgcatgtgaaggggtgggcggcgtatacgtcgtatttgacggcagagtcattcaaggcacacgcgccattaaattaagaacgaaaagctatgatgcatttgagagcattaactatccgtatatcgcgtttattaccgaaaacggaattgaatacaacaaacaagtgcacatgccaaaagacgatgcttttacggtcaatacttcactttgcacggacgtgtgcctgctcaagctacacccggggctgaaaccggaaatgtttgacgcattaaagggcatgtacaaaggaatcgtcattgaaagctacggcagcggcggcgtgccgtttgaaggaagagacattctcgccaaagtcaatgaaatgattgaaagcggcattgtcgtcgtcattacgacacaatgtcttgaagaaggagaggacatgagcgtctatgaagtcggccgaagagtcaatcaagatctcattatccgctccagaaatatgaacacggaagccatcgtgccgaaattaatgtgggcgctcggccagtctcacaacttggctgaagtcaaaaacattatggagacaccgatcgcagacgacgttgtactgtaaaaacatgactaccacaaagagaaagtagggttttagcatgacaaacgcgcaaaaagaatatcgtcaggaaaaagatttcctcggagaaaaacaaattgaagctgatgtgtattacggaatacaaacgctgcgcgcgaaagaaaactttccgattaccggataccgcatccacgaagaaatgattaatgcgctcgccatcgtcaaaaaagcggcggcgcttgccaacatggatgtaaaacggctgtatgaaggaatcggaaatgcgattgtacaggccgcagatgaaattcttgagggaaaatggcatgaccaatttatcgtcgatccgatccaagggggagccggaacgtccatgaacatgaatgccaacgaagtaatcggcaacagggctcttgaaatcatggggcataaaaaaggtgaatacattcacctcagcccgaacacacacgtcaacatgtcacaatcgacgaacgacgtgttcccgacggcaatccatatttcaaccttgaaacttttggataagctccttgatacgatggcgcatatgctcagtgtttttaaagataaagcgaaacaatttgattctgtcattaaaatggggcgcacacaccttcaggacgctgtgccgatccgtctcggacaggaatttgaagcatacagccgcgtgcttgagcgtgacataaagcgaattaaacaatctcgccagcatctgtatgaagtaaacatgggggcaacggccgtaggtacgggacttaacgccgatccgcgctacatagaacaggttgtgaagcacctggctgacatcagcggactgccgcttgtcggcgccggccatttggttgacgccacacaaaacactgatgcgtatacggaagtttcagccgcgttgaaagtatgcatgatgaacatgtcgaaaatcgccaacgatctgcgcttaatggcttcaggtccgcgcgcgggacttgcggaaatttcattgcccgcccgtcagccgggatcatccattatgcctgggaaagtcaaccctgtaatggcagagctgatcaaccaaatcgccttccaggtcatcgggaatgacaatacgatctgcctcgcttcagaagcgggccagctggagcttaacgtaatggagccggtactcgtatttaacctgcttcaatccatcagcatcatgaataacgggttccgttcatttaccgaccattgtctggcgggaattgaagccaacgaaaaacgtctgaagcaatacgtggaaaaaagcgtcggcgtcattacagcggtcaatccgcacctcgggtatgaagcggctgcgcgaattgcccgtgaagcaatcatgacggggcaatctgtaagagatctttgccttcaaaatgatgtactgacagaagaagaattggatatcattttgaatccgtatgaaatgacaaaaccggggattgccggaaaagatctattagaaaaataaattttaaagcaacaacagccgccttttcacgttttttagtgaataggcggttgccatacaaagggatgaggcagtatagtataatttgttatatcatttgatgaaagcgttttagcttttttcttctagggggattttcttgtgaaagaggccagattgccaaatttattggaaattattatcttattattcgggtttttagcacttgtcttatcgttcacagtgtttttagacctgccgatccagctagctctattaatatcctggtttttcgctattattctcggagtcaggctgggatattcatataaagacttgcaggcttcgattgtcaccgggatatcaaacggtcttgaagcggtattgattctcgtttcggtcggtgcgctcatcgggacatggattgccggcggcgttgtgccgacgttaatttattatggtttagagtttattaatcctcatattttccttctggctacactggttatttgttccgttatgtccgttgcgaccggaacgtcgtggggaaccgtgggaaccgcagggatcgccatgattgccatcggagagggaatgggtataccgcttccgatcgtagcgggagccgttttgtccggggcttacttcggagacaagctttcaccgctgtctgacagtacggtgcttgcctccacgctttctaaggtggatgtgctgtcacacgtcagagcgatgatgtatctgtcaattccgtcctatattattacggccattctgtttaccgtaacgggatttatatacggcggaaaaaatattgatctcgacaaagtggaatttttaaaatcttcattgcagaaaacatttgacattcatatatggatgctcattccggctgttgtcgtcgttgtccttctgattttgaaaaagccgtctatgcccgttattatcatcggtgctttgcttggcgcaatctgggcttccgtctttcagggaatgaattttgctagtgccatcgcgactgcttataatggtttttctattaaaacggacgtcgaatttttaaacggcctgttaaaccgcggaggcattaccggtatgctggatacgttagtcgttatcctgttcggtctcggttttggaggaattctcgagaagctcggcgtattaaaagtgattgtctcaacttttgagaaaaagctgaccacaccgggaaatgtgacgctttcgacattgatcgtcgcccttttaggaaacattttcggctgtgcgatgtacgtgtcattgatcctgacgccgaaaatcatggagaacagttatgataaactgaaacttgacagaagagttttatcccggaacgcagaggtgggcggcacgcttacttcagggatggtgccgtggtctgataacggcatctatatggccggcattctcggcgtatccacattttcttatctgccgttcatgtggctcagttttgtatctatcggactggcaatattgtacggatacacggggaaattcatttggtacacgaaagaaaaatccttgcaatctcaaaaattgggttaggaggttcatttcatgattacaaagcatatgattcggacgttaatgattgaaacgccgactgttcccggaaatctcggaaaagtggcaaccgccatcggagtgatgggcggagatatcggggaagttgaaaccgttaaagtcggcccgaactacacaatgcgcaacatcacggtgcaggccgaaaatgaagagcagctgcaggaaatcattcaagccattgaagctctcggtgaaggcatccggcttcatacagtctcagatgaagtgctctctgctcatgaaggcggcaaaattcagatgaaaagcaaaatgccgatccggacactggctgagcttggccgtgtttatacgccgggcgtcgccgatgtgtgcagactgattgaaaacgagcctgaaaaagcgtccatctatacgacaatcagcaattctgtcgccattgtcaccgacggaacggcgattctcggcctcggcaatatcggctctgtcgccggaatgcccgtaatggaagggaaagccgcgctttttgaccagctggcgggtatcagcggaattccgattttgctcgatacctctgatccggaagaaatcattcgcacggtaaaacatatttccccggggttcagcggaattctgcttgaagatatcggttcgccccactgctttgacattgaagaccgcctgaaagaagaactggacattccggttatgcacgatgaccagcacggcacggcggtcgtcacgctcgccgccgccatttccgcttgtaaaagcgccggtcttgatttaaaagaagcgaaggtcggtcagatcggtctcggcgcggcaggcgtcgccatctgccgcatgtttatggcatacggagtcaaagcggtctgcggaacggacaagtcagaagacgcaatgaaccgcctcgctcagtacggaggtcagccgcttggaagcatcaaagaattaatggacacgtgtgacattgtgatcagcaccacaggagttccgggtctcattaaaaaagaggatgtcagaaaaggacacgtcattctggctttatctaatccgaagccggagattgaaccggaagaggcattacaagccggagccgcttatgcagctgacggccgttcggtcaataatgttctcggcttcccggggattttccgcggcgcgctgaacgccaaaagcaagaaaatcgaccatgaaatgcttgtggcggccgcagaagccatcgcctcttgcacgaaacacggcgatctcgtgcctcagcctttggatgcggacgtgcatcaagccgtatcagcagccgtagaacgggccgcggcagggaaataaacaactcttacagtaccggacatgtgccggtgctgtttttttatcatgaataggaagcggaattcttaggcaggctaacagatagcaaaagacggaataaagaggtgtcgatgtggattattttccgctgatccatacaaatatttgggatgctgtgatcggcgtgccggtcgtcttatgcgtcacacagctgatcaaagtgttctgccgggttccgggcatattcgttcccacgattgcccttgctgccggaaatgttgtgtctatcgttttcggtcatcatgaacacgtgtatgcggggatttttatggggtttttttacggatacgccgcaatggggagctattcatctgccaaaacgtctctgcgcgcttaccggtcgaaacatgagccgtattcatgaacacatctggatttttttgttatgataaagaaaagggaaaaaggagcggttggcacatggcgaagagcaaaacgaaaaaaatgcgggagcatctcaaaagaaacgggatgcgtgacgcagtcctgtcaagggggacagcgccgtctttcagcacccatgaaagagtgacgaaaaccaaaaaagacaggcttgaaagaataaagcataaaaaaaggaacccctatgatcaccggagtgatgacgggggttctttttttatgcctgaatctcgcgcctttctatgatttctctgtcatgttttctcttttctttcatacaatctactaaatcaagtcaatagattagcgggaggaaagcggtatgagaaaacaatcgtacaaagaactgttttttcgccatgtaaaggatcatctgtcactttatatatttgtgttcgtcttgtttttgatgggggtcattttcggggcgatcatcgtcaacagcatgaccatcacgcagaaagaagatttgtattactatttaagcaagtttttcggacagctgtctgacggaaaacatgccggcgcttcagaaatgttttggcaggccgtctttcatgatgtgaaatatttggggctgatgtggattctcggtatttccgtgatcggtcttccggttattttcattatggtgttcttaaaaggaatcgtcgtcggcttcacggtcggttttttagtgaatcaaatggggatgaacgggtttttcctgtcatttatttcggttctgccgcaaaacatcgttctcattccggcgtatcttatcatggggacatgctctatcgctttttcactgaaactgatccggcagctgtttgtcaaacgcagccttcatgacgcgccgatccaatggttcggacgttacgccttcgtgctgattctcatcgttttcttctcggtcatcgcctcgctgctcgaggcgtacgtgtctccgctgtttatggaaaagctgtcatcacgcatattttagaattattatcacaaaataatacttttatttatcagtttataataattatagttggaactctgcgcgtattttgttataatgagtcatggaatgcggcgtaggagggaaagacatggaaaaccgtattgatcgaattaaaaagcagctgcactcgtcaagctacaagcttacgccacagcgggaagcaacggtaagagtgctgcttgaaaacgaagaagaccatttaagcgcagaagatgtatacctcctcgtaaaagagaaatctcctgaaattggtctcgctacagtataccgtacattagaattattaacagaattaaaagtcgttgataaaattaacttcggggacggcgtatcccgctacgaccttcgcaaagaaggcgcggctcactttcatcaccatttggtgtgcatggagtgcggagccgtcgatgaaattgaagaagatctgcttgaagacgttgaagaagtgattgaacgtgattggaaatttaaaattaaagatcatagattgacttttcacggaatctgccaccgctgccgcggggatgaaacagagtaaaagcctacgaaccttttctgccaggaaagggttttttgctgtctttatgtataaaagcctttgaaattggcataaggtgtactaacagccgccaaaagaaagggtcgatcgaaagatgggcagattcctaaaaacagccgcggatacgatcaaagtgtttattctgttcacaggttttaccgcgctgttctattatgctatgatatgggtgaattcagagtatgaaaactatcatcggtacgataaaccggaaggctccgccgtcaaagtggccaaaacggaacatgaggagaaagacggctggttcggccgattgatctttttttaccaaaacggggagtagatcaagagtgaaggatcaaattaaggatttcatccattatgtgagggttgaaagagggctgtcccaaaatacgatgatgtcctatgagcgtgatctgaaaagttattctctcttcttaactgaaacccttcagatcacttcatggaatgatgtgacccgtcttcatattattcaatatttaaagcatataaaggactccgggaaatccggcaagacgtctgcgaggcatttggcgtcaatccggtcttttcatcaatttctgttaagggaaaaagccgcggataaagatccttcggtacatattgaaacacaaaaaacagagcggacgcttccgaaagtattggcgcttcaggaagttgagcggttattggacacgcctaagcttgacagcccgttcggcctcagggataaagccatgcttgaactgctgtacgcgaccggcatcagggtcagcgagatgatcgagctgaaattatccgacgtccatttgacgatgggatttgtccgctgcttcggaaaagggcggaaagagcggattgtgccgattggtgaagccgcttctcatgcgatagaagcatacattgaaaaagccagagggaaattattaaagaaaaacgtaaccgaagcgctttttctgaatcatcacggcaggcagatcagccgtcagggattctggaaaaacctgaaaaaaatcgcacttgaagcggggattaaaaaagagctgacaccgcacacgctccggcactcctttgcaacgcacctgctcgaaaacggggcggatctgcgcgccgtgcaggagatgctcggacatgccgatatttccacgacgcaaatttatacgcatgtgacgaaaacaaggctgaaggacgtgtacaaacagtatcatccgcgcgcttaggagccgctgccagaggggccgcggctttttttgccggattggcggaatacagagaaggttctaattatttgaatcggcattgtcaacaagaatgtaaacggtttatacttgagttgtctgacctctgtaagctacaatggacagatggaagaaaaggaggcttttatgatgtctgaatacaaatataaccgggtatttttgatcgtaatggattctgtcggaatcggtgaagcgccggacgccgccgattttaatgatataggcgcaaatacgctcggacacatcgcagagcacatgaacggcttacatatgccccatatggcgcagctcggtctcggactgatcggagacattaagggcgtggaaaaaacggagcaccctcttgcgtactacggaaaaatgcaggaggcgtcaaacgggaaagatacgatgacggggcactgggagattatgggcctctacattgaaaaaccgtttaaagtgttcccggaaggatttccggatgaacttcttcaggaacttgagcggcgttcaggacggaaaatcatcggaaataagccggcttcaggcacggcgattctggacgagctcggaaaagaacatatggaaacgggtgcgctgatcgtttatacatcagcagattccgtactgcagattgcggctcacgaagatgtcgttccgcttgacgaactgtacagcatctgtgaaacggccagagaactgacgcttgatccgaaatacatggtcggccggattatcgcaagaccgttcgtcggagaaccgggcagcttcaaacgcacgccgaaccgtcatgattatgcgctcaaaccgttcggccgcacggtaatgaacggaatgaaagacagcggattagacgtcatttccatcggcaaaatttctgatatttatgacggagaaggcattacatcttcccgccgcacggtatctaatatggatggcatggacaaagtgattgaaacgctcggtgaagagtttacgggtctgagctttgccaacctcgttgattttgacgcgctgtacggacaccgccgcgatccggaagggtacggtaaagcgctcgaggaattcgacgcgaggcttccggaagtgtttgagaaaatgaaagaagacgatctgcttatcatcactgcggatcacggcaatgatcctgtccatcacggcacagatcacacgagggagtatgtgccgcttcttgtgtacagcaaaaagcacaaacacactgaacagctgccgcttgcggatacatttgccgatatcggcgcaaccattgcggataatttcaaaacggaaaagccggaatacggaaaaagctttttatcaagattacagtagggggactttttttgaaacaaaagatcgaacgtgctgctgcatttattaaagaacacgtgaaagaaacaccaaagatcggtctgattttagggtcagggctcggcgtattggccgatgaaattgaaggagctgtcaagcttacatatgaaacgatccctgattttccggtctcaacggtagaaggccatgccggccagcttgtgatgggaacgcttgaaggcgtgcaggtcatcgcgatgcagggccgctttcattactatgaaggctactcaatggatcaggtcacatttcccgtccgcgtgatgaaggcgctcggcgttgaatctcttgtcgtgacgaacgcagccggcggtatcaacactgaattccgcgccggcgatctgatgattattacagaccacatcaactttacgggcaccaacccgttaatcgggccgaacgaagctgaattcggaccgagattcccggacatgtcagaagcctatgacaaagagctgtcaggcttggctgaaaaaacggccgatgagctgggcattcctgttcaaaaaggggtgtatacagctgttacggggccgtcttacgaaacgcctgctgaggttcggtttttaagaacgatgggttctgacgctgtcggcatgtcgaccgtgccggaagtcatcgtcgccaaccacgcggggatgcgcgtgctcggcatctcatgcatttccaacgcggcggcaggtattcttgaccagccgttatcccatgaagaagtaatggaaatgacggaaaaagtaaaaggcggctttttgaagcttgtaaaagccgtagtcgcacgatctcaaaaataagtcagcatcagtcagctgtttcttcggaagcagctgtttttttgtgccctcaacacgaaacattttccagatgaggcgtataaaaccaccggatttggaaaaaataaaaaggattatgaaatggagggctttggagatgaaacgtcttatatccactttgttgattggcattttattaacggcatcagcaccgtccgcttttgcaaagccggacggaaaacatacatcggagctcgctcatgaagccaaaagcgccgtgctgattgaacgcgatacgggaagcattctttataacaagaacagccgggagcgtctggcgccggcaagcatgacaaaaattatgaccatgcttttaatcatggaagcgcttgacaaagggaaaataaagatgagcgataaagtcaggacgagtgaacatgccgcgtccatgggcggatcacagattttccttgaacccggagaagaaatgacggtaaaagaaatgctcaaaggaattgcgatagcttccggaaatgacgcatccgtcgcaatggcggagtatattgccggttcagaagaggatttcgtcagccggatgaacaaaaaagcaaaagaattgggattgaaagatacctccttcaaaaacccgacgggactgcctgaaaaagaccattacagctctgcttatgacatggcgaaaatggcgaaggaattattgaagtatgataaaatcactcaatttacgggaacgtatgaagattatttaagagaaaacacagacaaaaagttctggctcgtcaatacaaaccggctgatcaaattttatccgggtgtagacggcgtgaagacgggctttacaggcgaagcgaagtattgtttaaccgccaccgctaaaaaaggaaatatgagggtcattgctgttgttttcggagccagcactccgaaagacagaaatgcccaagtgaccaaaatgcttgattacgccttcagccagttcaaaacacacccgctgtacaaacgggatcaaatcgtcggaacggtaaaagtgaaaaaaggaaaacagaaactgatcaagctgaccacatctgagccgatttctcttctggccaaaaagggagagaacatggacaaagtaaaaaaagaagtgaaaatcaacggcaatgtaacggctccggttaaaaaaggagaggtgctcggcagcctcgttctgaaaaaagacggaaaggtgctcgttgaaagcccggtcacggcaaaagacgacatggaaaaagcgggttttctcacttttctgaagcggacgatgggagattggactaaatttaaataatcgtggcgaacgggcactagttttgtcatagtgaaggaattgctttcccgaaaatcgaaacactcattatccgatcatatcaaggaggaatgagcatgagccttggaattgactttcatgtcaaagaatccgtgctttgtattcgattaacaggtgaactcgaccatcatacggcagaatcattaaaacaaaaggttactgaatcgctggaggctgacggcatccgtcacattgtgctgaaccttgaagatcttaccttcatggacagctccggcctcggcgtgattttagggcgttataaacaaattaaacagctcggcggagaaatggtcgtgtgcgcgatttcacccgcggtgagacgtctgtttgacatgtccggcctgtttaaaatcatcaggttcgaacaatcagaacaaaaagcgcttttaacgttgggggtggcatcatgaaaaacgagatgcatcttgaattttcagccctcagtcagaacgaatcgtttgcgcgcgtaacagttgcttcttttatcgcacagctcgacccgacgatggatgagctgacggaaatcaagaccgtcgtatcagaagcggtaacaaacgcgatcatccacggctatgaagaaaactgcgacggaaaggtgtacatctccgttacgctggaggatcatgtcgtctatctgaccatacgtgacgaaggcctcgggatcacggatcttgaggaagcgcgccagccgctatttacgacaaaacccgagcttgaacgctccggaatgggctttaccattatggaaaacttcatggatgatgtcacgattgattcctcgccggagatgggaacgacgatacgcttaacaaaacacctatcaaaaagcaaagcgctttgtaattaaggagatttgttatggatgtggaggttaagaaaaacagcaaaaacgcgcagctcaaggaccatgaagtcaaagaattaatcaaaaagagccaagagggcgaccagcaggcaagagacctcctcatagaaaaaaacatgcgtcttgtgtggtccgtcgttcaaaggttcttaaacagaggctatgagccggacgatctgtttcagatcggctgtatcggattgttaaaatccgttgataaattcgatttgtcctatgatgtccgtttttcaacttatgccgtgccgatgattatcggagaaatccagcgcttcatccgcgatgacggaaccgtcaaagtttcaagatctttaaaagagctcggcaataaaatacgccgggcgaaagatgaactgtcaaaaacatacggaagagtgccgaccgtccaggaaatcgcggaccatttagaaattgatgcggaggatgtggtgcttgcgcaggaagcggtgcgggcgccttcatccattcatgagaccgtgtatgaaaatgacggagacccgatcaccctgcttgatcagatcgccgatcattcagaagagaagtggtttgacaaaatcgccctcaaggaagcgatcagtgatttggaagaacgggaaaaactcattgtctatctgagatattataaagatcagacacagtcggaagtagccgaacggctcgggatttcccaagtccaggtatcgaggctggagaaaaaaatattaaagcagattaaagtgcagatggatcatacggaaagctgaccttttacgggccggctttttttatttgtgcatcggtggtaatttatggtcttttgccgctgatgaatgagaacaaaagtgaaccgcatactacatatataaccacccgaaagatggtgatgcaagatggaaagacgaatatttctcagacttcgccaccgcgtgaaggctcataccggagatatcatcacaatcggcgacgccgcgcagatcgcgggacagcaaaagctgaaaaaaaaactgtcggcactgccgctgtataaggtcacgaaaaaagacaaaaatatcgtcgtgctggacatcataaaagtgctgaaaaccattcataccgcttttcccgctcttgatgtacagaccgtcggcggcgctgaaacgatagtggaaatccattaccagaaaaagcagctgtcagccgttttgttcgtcggtgtctggctcctgctttttatcggttcatgtcttgccattatgaattttcatgaagatgtcagtatgagagaagttcatatcgccttatatgaaatcataacgggcgaacggaatgaatatccgtatctgcttcagattccgtacagcatcggcctcggtctcggtatgatcgtcttttttaatcacatcttcaaaaaacgcctgaatgaagagccaagcccgctggaagtcgagatgtttaattatcagcttgatctcgatcattatgtcgcaatgcacgaaaatgaagagacgatgaaagatctgcatgatcgttagcattcttttcgttatatttgtcgggcttggcggagggctgaccgtgggtgcgggatttgtggcttttttaaccgttatgggaatcatcccccgccttatgcagctgacaaaaacaatgcgctttgtacaggcctacgaaggagctgttatttcaggagctgtgttcggcggctgggaaaccttaaatatgaatcatttttttttaactgaatggctggccgttccggtcgggcttttggccggcatgtttgtcggcatgctggccgccgcgcttacagaagtgctgaatgtgcttcccattcttgccaaacggatcggcttcggcagcaaaatcatcatattgctgatggccattgtgttcggcaaaatagccggctctttatttcattggctgtattttatccatcattcataaggaggaaccgacatgacaaacttaaaagaaaattacaaaacaaaagtgaaagactatcagccgaaaccgccatatgtttggaattgcgtcaaagcctttctgatcggcggtttgatctgtctgatcgggcaggctcttcaagacttttacatccacttttttaattttaatgaaaaaacagcgggcaacccgacggccgccactcttattttaatttccgcccttttgaccggattcggcatttatgacagactcgggcagtttgccggagcgggttcagccgtgccggtgacgggttttgcaaacagtatgacaagcgccgctctggaacacagaagtgaaggactcgtgctcggagtagcgacaaacatgtttaaattggcgggaaacgtcattgtattcggcgtcgtggcagcctatatcgtaggcctgatacggtttgcttgtgaaaaactgttttcgtaggaggagaaaaaatgaaattgaccggaaagcaaacctgggtgtttgaaaacccgttatttgtaaatgcggcgggaacggcagccggaccgaaagaaaaagacggcccgctcggttcgctgtttgataagacatacgatgaaatgcattgcaatcagaaaaactgggaaatggcggaacgtcagttaatggaagatgccatcaactccgctttgcaaaaacagaacttgaaaaagagcgatattgatttgttactcgcgggggatcttttaaatcaaaatgtgaccgccaactacgtcgccagacatctgaaaattccgttcctctgtctgttcggcgcctgttcgacatcaatggaaacgattgccgtcgcatccgcgctcattgacggcggttttgcgaaccgtgcgatcgcagccacgagcagccataacgcgacggcagaacggcaattccgcaatccgacggagtatggcgggcaaaaaccggataccgccacttcaacggtcacggggggcggggcggtcatcatcagtcaaaacccttctgatatcaagattacaagcgcaacagtgggaaaagtaagcgacctcggaataacagatccgttcgatatgggatccgccatggcgcccgctgccgccgacacaatcaaacagcacctgcaggacttaaaccgcacggcggatgattatgatctgattttaacgggagacctttcaggcgtcggctcgccgatcgtgaaagatttgctcaaagaagaaggctatcccgtgggaacgaaacacgatgactgcggtcttctcatctatacgccggaccagcaggtgtttgcgggcggaagcggctgcgcctgctccgcgcttgttacgtacacacatatttttaaccaattaaaagcggggattctaaacagggtactcgttgtcgcgacaggagcgcttttgagtccgacaatgatccagcagaaggaaaccattccgaccatcgcgcacggtgtggtatttgagcgggcgggaggtgcatcataaatggaatatctgttggcttttgtttgcgggggaatcatatgcattatcggtcagctgctgcttgacatttttaaactgacacccgcccatgtgatgacaacttttgtcgtcatcggcgccttgttagatgggttcggaatttatgacaaatttatcgaattcgcgggcgcgggcgcaacggttcccatcgtcagcttcggtcacagcttattgcacggcgccatgcatcaagctcacgagcatggatttatcgggatcgccatggggatttttgaacttacttccgccggtatatcttcagcgattttattcgcatttcttgtagccgttatttttaaaccgaaaggataatgcctgatgacgaaacggaaggtcattcttgtgacagacggggacgtgtacgccgccaaaacaattgaatatgccgcggaaaaagcaggcggacggtgtatttcccaatcaaaaggcaatccgtcaacgagaagcggccccgaacttgttcagctgattaaagccgcgccgaatgacccggtgtttgtcatgtttgacgattcaggcctgcaaggggaagggccgggcgaaacggcgctgaaatatgtcgcctcacatcaggacattgaagtgctgggggtgattgcggtcgcttctaagacccatcaggctgaatggacgaaagtcgatgtctccattgaccgtgatggagaagtgacggagtttggcgtcgataaaaccggaatgagagaaatggacgagcacagaatgaacggagatacggtgtattgtctggataaattggacgttcccctcattgtgggcatcggcgacataggaaagatggggagaaaagatgacatatccaaaggctcgccgatcacgatgaaggcggtcgaattcattttagaaaggagcgaaagccatgccggaaaaaccggaaaacatgatcaaggtgtaccgggatcctagaaaaaatgaacaattttttaaagaccgcgtcggtatgggaacgagctatgatgtcggcgtccgcaaagttcgagtattagaccgggaagtccagatttactttgtcaacggattaaccgatactttgtttatcattcatttaatggaacagctcgtcgacgtcaataattatgacgagaatgcggatgaagcgattgacgttgttgaaaacaggcttgtcaatcagcaggtccaaaaagtcaaaacgctcgacgaagcaacggatcaagtgctttccggacttgtggcggttatcgttgaagacgcgggcttcgcctttatcgttgacgtcagaagttatcccggacgcacacctgaagaaccggatacggaaaaggtcgtccgcggtgcaagagacggttttattgaaaatatcgtcattaatacagcattgatcagaagacgaatcagggacgaaaggctccgcgtcaaaattacgaaagtcggcgagcgctctaagaccgatcttgcgattgtgtatatagaagacatcgcggacccggaccttgtcagcatcgtcgaaaacgaagtgaatgcgattgacattgacggattgacgatggctgataaaacggtggaagaattcatcgtcaaacagggttacaatccgtttccgatggtcagatacacagagcggccggatgtggcagccaatcacattttggaagggcacgtcatcatcgtcgtcgatacgtcaccgagcgtgatcataacgccgacaacgatatttcaccatgttcagcatgcggaagaatacaggcaggcgccttcagtgggcacatttttaagatggatcaggtttttcggtattattgcttcaaccgttctgcttccgatttggttcctctttgttctcgaaccgtctcttctgcctgaaagattggattttatcggtttaaataaaaatacgcacatcccgatcattctgcaaatctttttggccgatttggggattgagtttctcaggatggccgcgatccatacgccgaccgctttatccaccgccatgggtctgattgcggcggtgctgatcggtcaaatcgccatagcggtggggctgttttcagcagaagtgattctgtacgtatcgatcgccgccatcggatcatttaccacgccgagctatgagctcagcctcgccaataaaatgatacgcctcatcttaatggtgctcgtggccattttccaagtaaaaggctttgtgataggttttacattgctgctgatcataatggcgaatatccgctcgtttcacacgccgtatttatggccgtttttaccgtttaacggcaaggcgctgtggcaggtgctcgtccggacgacagtgccgggagccaaagtcagaccgagcattgttcacccgaaagaccgtcaaagacagccaagcggttcataatcgcattgaaaccgacagaagattatgatattgtatgtcttaacttatacgggacttgtataaggacagctcaaaagaagctgtccttttcacccatatgcggatcagaaagagggaatgagcattgttcttacatggcacaagcagacaaaacaaactaggtcatttggaaatcggaggtgtggacgcgctgtatttagcggagcattacggcacgcctctttatgtttacgatgtggctttaatacgtgagcgcgctaaaagctttaaacaggcattcattgacgcggatttaaaggcgcaggtcgcgtacgcgagcaaggcgttttcttccgttgcgatgatacagctcgctgagcaggaggggctctcattggacgttgtatccggcggagagctgtttacggcggttgcggctggttttccggctgacaggattcactttcacggcaataacaaaagcgaagaagagttgaaaatggcgctcgatcatcaaatcggctgcattgtcgttgataatttttatgaaatatccttactcgcggaactgtgccgcaaatcagggcgcacaatggatgtgcttctgcggatcactccgggggtagaggcgcatacgcatgattatattacgacgggacaggaagattccaaattcggttttgatctgcataacgggcaaatagaaaaggcgattgaacaagtattacagtcagaccatatccgccttctcggcgttcactgccacatcggatcgcaaatttttgatacggcgggctttgtgctggccgcagaaaaaatctttgcaaaactgaatgaatggagagaatcattcggctttgtctctgaagtgctgaatttagggggcggctttggcatccgctacacggaggaggatgaaccccttcatcccgccgtttatgtggaaaaaattatcgaagcggtaaaagaaaacgcagcgctgcacgcttttgacattccggagatctggattgaaccgggacgctcgctcgtcggagacgccggaacgacgctttataccatcggttcgcaaaaagaagtgcccggcacccgtaaatatgcagcggttgacgggggcatgagcgataatatccgtcctgcgctgtatcaggcgaaatatgaagccgtatcggcaaacagaatcggagaacaccacgataaaacggtatccatcgcgggtaagtgctgtgaaagcggtgatatgctcatttgggatatagaccttccggaagtgaaagaaggcgatcttctcgccgttttctgcacgggagcatacggatacagcatggctaacaactacaaccgcattccgcgtcccgccgtcgtttttgtggaagacggcgaagcgcatcttgtcattagaagggaaacttatgaagacattgtaaaactggatctgccgtttaagacgggggtcaaacaataaataaaaaagagaccggaacaatggcgtccggtctctttttgcattcagctgttgttagaacttgatccgctgtctcctgtaaatacagacacgatcgcattccaaatcgaagcgaagaagtcaatgactttttgaacaaagcttttgccttcatcggattgaatgaacttcgtgattttgtcttttgccttgtcaagctggctgccgacttggccccaatcaatcttggcatttttcattttattaaacaatgaaacgagctggtctttttgagcgtcagtcagtgtaatgttaaggtttgaagccgcatcatcgacctttttctcaattccttcttttgtatcgggcacaccgtttttcgcgaaatcatctttaatgtttgcgatgagcgcggaggcgtttttatccccgattttatccccgagatttgaagtggtgacaagctcttggttggcgacctgttttacatcttctgaaatcgctttgtctgatgagacttcatatgccttgatgattcccgttaatgctgcggtgcctgatacctcaaacggcgccgtcacgtatactttcgcatctttcactcctgctgtcatcagggcgtttaagtacatttcatccgtgatggaatcgatattatgggtcttaacgtcaagcccggaccctttctttgccaccgtgatggatgatgaagagatggctcttgtgccgatttgggcattcgatatatattttcccagatattcatgttcttctttattcgtgaccgtcacttttgtcgcgttatcagggacatttaattcgtcaagcactttctgacggttttcgtttgacagatccgcccccagtgtgacgatgacatctccgactgcggcatcggccaggctgattttcggtattgtgcacaatacaacggccgccgccagcaatccaatccacatttttttcaaagcggttaacctccttcttttcacaaatgccgttttgaagcggtttgtgagggcctgcgtgaagcagttccgatacatagacggctgtgaagctgttctggtttcattttctttctgcggaagcggggagattcgttttccggctgaaggtgtggtataatagccgcgaaaagaagagcagaggcctcttccttcaaaagaatatcaaaaagaaagccggcttacaattgaaattcatattgaagaaggctttgacaaaaaacaatacggaagtaggaatgagaatgaaaactggttatatcgaaatggaaaacggcagcagaatcgaatttgaactttatccgaatgaagcgcctaatacagtcgctaactttgaaaacctggcgaatacgggcttttatgacggcgttattttccaccgcgtgattccgggctttgtgagccaaggcggagatccgactgggacaggcatgggcggaagcggaaaaacgatcaaatgtgaaacagaaggcaatccgcataaacacgaagccggttctttatcaatggcgcatgccggtaaagacacgggttcaagccaattcttcatcgtacatgagccgcagccgcatttaaacggcgttcatactgtattcggaaaagtgacaagcggtttagagcatgcgaaaaacatgtctaacggagacaaaatgaaagaaatccgtgtagaaggataatgacaaaaaacccgcctttttcaggcgggtttttttatgtatatgaaaattctcatgtgtaaatcatgaaaaaatacatatatgaacatcagcgatcattctggtatagtgaaaaagaccgattacaacaatgaaaagaggtagaaacgttggttcaattggcaaccgttttatttgtcattatcattctcgcacttatgatttggttcagggtgaaaaagggaaacaggccgattaaaggcggcggcttcggcatcattctcccgctattgattatcgccgtcatttttacattcagcatcagccagctcatgaatatcccgggaaagccgtttcattttcccgctctttgggagctcgccatcgccggactgttaggcgcggtattcggcgtcatcatgctgtcgcaaaccgcctatgaaatccgggaagacggctttgtctactccaagcggaataaaaactttaaatatgtcattatcgcgattattgcgatccgtatcgtgctcagccaatatttcaaaaacattgacgcggcggaattcgccgttttaacgatggaacttgcttttgtgtatttgtgcatttggcggatcggaagcttcgtgaaataccgtaaaatcagcagatccggcttataaaatgaaaaaaatggatgaggtgcggggcttatttgccctctgtgcagggattcatggtaaaataaaaacgaccatggctaatgggaggaaatcacttgaaatcagaaaaagaaaaaacttctaaaaaaagcgccgtacttgattgggcgaaagccattatcatcgctgtcgttctggcactgctcatccgaaactttttatttgccccttatctcgttgatggaagatcaatggatccgacgctgcatgaccgcgagagaatctttgtcaatatgacggtcaaatacataagcgacttcaaacgcggccagatcgtcgtgctgaacggagaaaacgagcactatgtcaaacggattatcggacttcccggcgacacggtgcaaatgaaaaacgatcagctgtacatcaacggcaaaaaagtgtccgaaccgtatttagcggcaaacaagcacaaggcgaagcaagaaggctatgaccggctgacagaagacttcggcccggtgaaggtgccggacgacaaatatttcgtcatgggtgataaccgcagagaatctatggacagccgcaacggcctcggtctctttacgaaaaaacaaatagcgggcacatcaaaattcgtcttcttcccgtttaacgaaattcgcaagacgaaataaaccgtacaggcagttttcttcatgaggaaaactgctttttttatataaatttatctttccaccctcaaaaacagaacataaattcgtatatctatttaatagatagaaagttttacagatacatgaaacatcttccctttatgaaacgttatatgaataactcacgcagggaagaacggttttctattcatgaaaaaaaggaatatgacatagtaatgaatagattgatacgggctggaggtagaaaaatgggaagaattaaaacaaaagcagccattttacttgtactgctgctgttattagcgggcggttatatggtcataaacgatattgaactgaaagacgtgccgactgcaatcggacaaaccctgtcccaggaaaaagaagaatatacagtcaaaacatataaaattacgaaaatcgaaggaactgagtaccacggtacggcagaaaacggcacaaaaattatttttaacggcgacaagctgaagcaggatctctccgatgtgaaaaagggagataagattaaagcgtatttcagcaaatcaaaccggattgacggcttattgaaggtcgtcaaagtgaacgaataaataaaggcaccttttatgggaaaagggcgctttttatttttctgaataattaggtgcaaattcattgcgcctgccgcaaaggatgttataatagcggataaggacaaaaaaatattgattgtatccttcggggctgggtgaaaatcccgaccggcggtaataaggcgttttgcgctttacagcccgtgacccgtatgcatctgtatacggtggattcagtgaaaagctgaagccgacagtgaaagtctggatgggagaaggatgagagaagctatgcaaaaaataaacttactgtatagtcttatttcctatggattaaaactggcaaagccccgaactgtgtaaacattcggggcttttttgacgccaaattgcgtggaagaagggagggataacgatggaagaatattatatgaatacggcaatagaacttgccagacgcggtgaaggacagacacagtccaatcctcttgtcggcgctgtcgtcgtcaaaaacggacagatcgtcggaatgggcgcccatttgcaatacggagaagcgcatgccgaggttcacgcgattcatatggccggcagacacgcaaaaggcgccgatttgtatgtgacgctggagccttgcagccattacggaaaaacaccgccatgcgccgaactgataataaagtcggggataaaaagggtgtttatcgctgtgaaagatccgaatccgcttgtagccggaaaaggcatcggaatgctggaagcagcgggcatcgaagtgaaaaccggacttctcaggcagcaggcagaagagctgaataaaatgtttcttcacttcatgcggaccggacttccgtatgtcaccttgaaagcggccgcgagccttgacgggaaaacagcgactgaaaccggtgacagcaaatggattacatcagaggcggcaaggcttgatgcccagcaatacaggaaatcgcatcaaagcattcttgtcggagcaggcacagtcaaagccgataatccgagcctgacctgcaggcttcctgatgcggtgaagcagccggtcagagtgattctcgatacaaagctgaccattcctgaaacggcaaatgtgctcactgacggcgctgcgccgacatggatatttacggccaaaggtgcagacgtgcaaaagaaagaccggctgaccgcactcggaataaaagttattccgctggaaacagaccgcattcacgtccctgaggtgctcagtattctcgctgaaaacggcataatgtcggtttatgtggaaggcggagcatccgtacacggaagttttgtcaaggaaggctgtttccaagagcttcatttctatttcgcccctaaattaatcggaggaacgcttgctcccagcttgatctccggtgaaggttttcaatcaatgaaagatgtcccccatttacaattcacacaaatcacccaaatcgggccggatataaaactgacggccatacctaaagatggaaaggatggtgacgatgtttacaggaatcgttgaagaaacaggcacgatccaagcaatcaaaaagacaggcctttccatggcattaaccatcgccgcttcaaaagtgacaagtgatgtgaaacttggcgacagcattgcggtaaacggcatctgcctgaccgtaaccggattttctgacaatcaatttacggttgatgtcatgccggaaacagtgaaagccacttcgctgaacggcttgtcaaaaggcagtaaagtaaacttggaaagagcgatgtccgccaacgggcggttcggcggccactttgtatcagggcacgtggacggaacggcggaaattacgcggatcgagaaaaaaagcaacgcggtctattacgatttaaaactttcgccggaactgacaaaagcgctcgtattgaaaggttcaattacggtagacggcgtgagcctgacgattttcggtttatcagacgaaagcgtgacggtatccatcattccgcataccatctcagaaacgatttttcagacgaaaacagtcggatcgaccgtaaatattgagtgtgacatgatcggcaaatacttataccgctttttgcacaaaacagaacaaacgaaaagcaatcaaactatcacggaagcctttttaagcgagaacggcttttagaaaggaagatcgatatgtttcatccgatagaagaggcgttagaggcgctgaaaaaaggtgaagtcatcattgttgtcgatgatgaagacagagaaaacgaaggagatttcgtagcgctggctgagcatgccacgccggaagtggtgaattttatggcgacccatgggagaggcctgatctgcacgccgctgtctgaagacatcgccggccggctggatcttcacccgatggtcgatcataatacggactcacatgagaccgcgtttacggtcagtattgaccacaggctgacaaaaacgggcatcagcgcgcaggaacgatcctttaccattcaggcgctgttgaacgaagaatctgtgtctgacgattttcagcgtccgggccacattttccccttaatcgcaaaaaaaggaggcgtcctgaagcgggccggccatacggaagcagccgttgaccttgcaaaagcctgcggatctcagggagcgggcgtcatttgtgaaattatgaatgaagacggcactatggccagagtgccggagttagccgaaatcgccgaacgccaccagctgaaaatgattacgataaaagacttaatagagtaccgttacaacattacgacccttgtgaacagagaagttgatattacgctgccgactgacttcggcacgtttagagtttacggatatacaaacgaggttgacggaaaagaacatctcgcctttgtcatgggggatgtcccgtttaacagcgaacccgttcttgtcagagtgcactcagaatgcctgacgggcgatgtgtttgcatcccatcgctgtgattgcggacctcagcttcatgccgcgcttgcgcaaattgctgaagaaggccgcggcgttctattgtatttgcgccaggaaggcagagggatcggtttaatcaataagctgaaggcgtaccgattgcaggaacaagggtatgacacggttgaagcgaacgaagcgctcggctttctgcctgatctgcgcaactacggcatcggcgcccagattctccgcgacttaggggttcagcatatgaaacttttaaccaataacccccggaagatcgccggcctcgaaggatacggtctcagcatttcagaacgggtgccgcttcaaatggaagcgagtgagcataacaagcaatatttaaagaccaaaatgaaaaaacttggacatctgcttcatttctaaaaacaaatctcacaaaaaaggatggataacatatgaatatcatacaaggaaacctagtaggaacaggacttaaaatcggaatcgtcgtcggcagatttaatgaatttattacgagcaagctgttaagcggagcggaagacacgttgcttcgccacggtgtagaatcaaacgacattgacgtcgcttgggtgccgggagcgtttgaaatcccgtttgcggcaaagaaaatggcggaaacgaaaaaatacgatgccgtcattacgctcggcacggttatcagaggagcgacaacgcattatgactatgtctgcaatgaagcggcaaaaggcattgcccaggcgggaacggcgacgggcgtcccggttatcttcggcatcgtgacgactgaaaccattgagcaggccatcgaacgagccggaacaaaagccggaaataagggagcggattgcgcagtatctgccattgaaatggcaaatttaaaccgttcatttgaataatttgttgaaaagcgtttaaaacagcggcgaaaatgatataatgtgaggaaacggatcgcctttatgtatccgtttgataggacatgaatggacattttggatatagaggggtttttatgttaattcgttataaaaaatcgtttgaaaagattgcgatgggtcttctgtcatttatgccgaatgaaaaagatctcaagcagcttcagcagacaataaaggactatgaaacggatactggccgccagctctttctttggaaagaggatgaagatatcgtcggagcgatcggagtcgaaaaaaaggactcagaagttgaaatccggcatatcagcgtgaatccttctcaccgccatcaaggaatcggaaagcaaatgatggacgccttaaaacgtctgttcaaaacggaggcactcgttccgaatgaattaacgcaaagcttttttgaacgctgtcaacatcaaaaagatcaggatatctcatataataactgacaaatgctcccggaatcttcacggtttcgggagctgttttgatatagaaaaagcagggctgaccgtcagcctctgcttttttttcttctctcaatttcccgttcgcgttccttaatgacatccgtcctgtcccgcaggcggtgtttatgaataagaaaggtatctgatacgccgtcttgcccccatgtatagccctttcggcggcattcggcaagacatgcttctttcagggcttcatctgtaatcggcagcataacacttctgtaaggcacgcccgcttctatatcgtctgacagcgtttctatcagctcaatcagcttcgggtggctgagaccgagagaacagaccgcctgcttttcagaccggagaatacgtaagctgttggcaatcagccgtttcgccccggcttcatttcccctgcgctggtgatacagagcgacggcaagctgaatcaggccgacccaatgaatgctccgcttttcagccgggctttctttccaatattcctctaacagttcatgacactcaaaataatctcttgatgcgtgaaattcggccaaaaagccgatataagctttaggatacaagccgcttcctccttttatgctaaaaccagtgtaccacagcgctatgaaaaggaaaaaaagagcggcttggtgtctgaagcctgaggaactagcagatgtaagatgctcctacgacaacgagcaaaataaacagaacgacaattaatgcaaaacctccgccgaaacaagctccgctcatgtgaaatcagcctccctttgtttcaagtttacacggctatcatatgtgcatccgcctttaaaggtataggcgtatatcttctttttcagtattttctaaataacggaggacgtgtataaaagtattggacgagagcatttcggtggattatactaaagggtagccagtttttccggcaatgagagtgatattgaaaatggtgagataatggtagaatatcaagtgaaaattgatacgtttgaaggcccattggacctgctgcttcatctgattaaccgtcttgaaatcgacatatacgacatacccgtggcaaccattactgaacaatatttattatatgtacatacaatgcaagagcttgaacttgatgtcgccagtgaatatctggtcatggcggcgacgcttctcagcattaaaagcagaatgctgcttccgaaacaagaggaagagctgtttgaagacgaaatgcttgaagaagaagaccctcgggacgagctgattgaaaagctgattgagtatagaaagtataaaaccgctgcgaaggatttaaaagagcgggaagaagaaagacaaaagtcatttacaaagccgccgagtgatttaagtgagtatgcaaaagaaatcaaacagacggagcagaaactgtcggtgaccgtttatgacatgatcggcgcgtttcaaaaggtgcttcagcgtaaaaaaatcacgcggccgaaagaaacgaccattacaaggcaggaaataccgattgaagacagaatgaacgaaatcgtaaaaagcttaaaaacggcggggagaagaataaacttcacggagctttttccttctcggcaaaaggaccatctcgtcgtgacgtttttagcagtcctggaactgatgaaaaatcagcagattatcattgaacaggaagaaaacttttcagatatatacattacggggagtgaatccattcatggcgcttgatatcgtgaattggaaagcgattgtggaagccctgctgtatgcggcgggtgatgaagggctgaccaaaaagcaattggtgacggtgcttgaaatagaagaagcggaactggccggaatcatggaagaagtggccgctcagtacaaggaagacgacagaggcatcgagcttaccgaatatgcggatacgtatatgcttggaacgaaaaaagaattcgtgccttatttgaaaaaactaatcgaagtgccgtcaaaagggctgtcacaggcttctttggaagtgctggcgatcgtttcgtacaagcagccgatcacacgggcggaaattgaagatatccggggcgtgaagtctgagcggattctgcacagcctcgtgtcaaaagcgctgctgtgtgaggtgggccgcgccgacggtcccggccgggcgattttatacggcacgacaccggtatttcttgaacaattcggcttaaaaacattggaggagctcccgccgcttcctgaaaatgcggaggaagacgttctccaggaggaagccgatttattctttgaaaacttcaaccaaacttttgaggatattaaataataatcgtttttcatcatacgatagtagggaaaggccattgatgaatgacgcaaatgacgacgtacaagagaggaaggaaacggacggaaatgggaaattcgattgtgagggcccatactgaagaaactggtgaatttttagccgaggttgtcacgatggtcagcagctatttaaatcatacaactttgccggagatgcgggctcaaggagaggcggatgaagcatactgccgcgacgtgctcagtgtgctgaggaggatgaccgtcttttgcgaaggcgcccaggaagcctgcaggcggcttttaatgcaggagccgtttcatgaggcgagagcggaaaaaacgctgtataaagtatatcatcagtgcgtggaggagtttttcatgccgaaaaaggatacatggtacgaaaacagccgcgccgcttatacaggccaaagcgcgattgaattctaccagcaagtgccggactcgctgcggagccttctgctttcgctcagcagtgaatttctgcgcatgcgggaagaattggcgcaatatgaagcatcaggctcaaatatggcatcagtcagataaaaactcttccttttgggagagtttttttatgtgaaagtgatgcaattggtattcataagtcatggacatgcgcataaacttgtacaaacccacaacaaggacgtgagcattcatgcgctttctcaaaaaagctgccgtatttcttttgacttttgttattcttttttccattacagacggcaatacggcacatgcccaaatacatgtcagcgcaaaaagcgcgattataatcgacggagcatctggcagggtgttattcgtcaaggatgaacatcataagcggcggattgcaagcattacgaaaatcatgacggcggtgctggcgattgaatcagggaagatggaagagaccgtgacggtttccccgaatgccgtaaaaacggaaggctcagccatttatcttcagccgggacaaaaagtaaagctgaaagatctcgtatacgggcttatgctgagatcaggaaatgacgccgctgcggcaatagcggaatatgtcggcggaagccttgacggttttgtatttttaatgaacaaaaaagccgagcaaatcgggatggaaaatacaaaatttcaaaatccgcacgggctggacgaccatgaaaatttatattcaacggcgtttgacatggcgcttttgactaaatacgcgatgaaaatcaaggaataccggaccgtttcaggcacaaaagtgtataaggcggaaacgatggaccgggtatggaaaaataaaaacaagcttctgactgggctctaccgttacagcacaggcggaaaaacgggttacacaaaaatcgcgaaacggacgctcgtctcgacggcctcaaaagacggtacggatctcatcgcggtcaccataaatgatccggatgactgggatgaccatatgaatatgtttaattatgtctttgatcactatagaacctatgtcgtcgctaaaaaaggcggcattccgaagctgaaaaagacgttttacggaaaacacgcttttattgcccgggatgtcaaatatttgttaaaagaggatgaaatcgacgatgtaaaaatcagcacaaccttaataaaaccgaaaaaagcctggaaaaaggacgcctctctcattcctgatgtcgtcggccggatgactgttatgcatgatgggaaagtgatcgccaagatccccgtctattatgaaaatgagcgccataaaaaaccgaaaaagcatttcattgagacgtttacgagcctgtttatgagcgcggcgggcggttcgtcatggtcaatttaatctgggtatgtctgacggtaatcggacttgtctttgcgatgtttaacggtaccttgcaggatgtgaatgaagccgtttttaaaggagcgaaagaagcggttacgatctcgttcggattaatgagcgttctcgtgttctggctcggcctgatgaaaatagccgagcagtccggccttttggatatattcagcagaatgtgccgcccgtttatttctaagctgtttcccgatattccccctgatcatccggcgatgggatacatcttatcaaatctcatggcaaactttttcggactgggaaatgcggcgacaccgctcggcattaaagccatggagcagatgaaaaagctgaatggaggtaagtctgaggccagccgttccatgattacctttttggcggtaaatacttcgagtattacattgataccgacaaccgtcattgccgtgcgcatggcttactcggcgaaatcaccgaccgatatcgtcgggccgaccatcttagcgactttaatttcgggaatcggcgcgattttcattgaccgctacttctggtaccgccgcaaaagaaaagggaggtaagcgaatggaaatggtgaattgggtgtctttagccatgattccgattattatcgccggtatattgatatacggcacgatcaaaaaagtgccgacgtatgaatcattcgttgaaggcggaaaagaaggaattgagattgcgttttccatcattccgtatttggtcgggatgctggtggcgattaccgtattccgggcctcgggcgcgctggattttgtcatggggctgtgcaagcctttctttacagcgctcggcattcccgcagaagtcgtgccgcttgctctgatccgcccgatttcggggacggcggcgctcggcatgacgacagatctgatcgccgtgtacgggcctgattcatttatcggcaggctggcctcggtcatgcagggatcgactgacacgacgctgtatgtcctgacggtgtatttcggggcggtcggcatcaaaaaaatgggggatgctttaaaggttggtcttcttgctgatttgatcggggtggttgcatcaatcatcatagttacgttattatttggaagcgcctgaaatcaggcgctttttatatatcagaataactctccttgaaaaagcttgtttgttcaaggggaaaaaagtaagattatacttgaggtgaacgacatggaaagactgcaaaaagttattgctcatgccggcgtggcatcacgcagaaaggcggaagagctgataaaagaaggaaaagtaaaggtgaatggaaaagtaataacagagctcggcgtaaaagtgaccggttctgatcagattgaagtaaacggattaaaggtggagcgggaagaacccgtgtactttctgctttataaaccgagaggagtgatctcagcagctgatgacgacaaagggcggaaagtggtgaccgactttttcaaagaagtgccgcagcgcatttatccgatcggcaggcttgattatgatacgagcggacttttattgctgacaaatgacggcgagtttgccaacaaactcatgcatccgaaatacgaaattgataagacgtacgtcgctaaagtgaaggggattccttccaaggaacttctgagaaagcttgagcgcggcattcagcttgaagaaggcaagacggcgccggccagagcgaaaatgctttccctggacaaaagaaagcagacgagcatcattcagctgacgattcatgaaggccggaacagacaggtccgccgcatgttcgaggcgatcggtcatgacgtgctgaaactaaaacgtgaagaatacgcatttttagatttaagaggcctgcgcacaggagacgcaagagaattgtcgccgcatgaggtgaaaaggctgcgggctttagctgaacacggtaaaaacgctttctaattttcacataaccttcaaaaattacaaaacgtgttgatgatataattgaatggatttgcaggcaggggaggggagcagtgtacaatgaacaaaaaacggcggcgtttattcattcggaccggcatccttctcatcttactctgcgcgctcggatataccatctataatgccgtatacacaaacggtgagcgtatatctgaggggtccaaagccccgaatttcgcgctgaaagatacagagggcagactcatagaactgagtcagttaaaaggaaaaggtgtttttctgaatttctggggaacgtggtgtgagccgtgcaagcaggaatttccctacatggagaatcaatacaagcattttaaagacctcggtgtcgaggtggttgcggtaaatgtcggcgaatcaaaaattgcagtacataattttatgaaaacatacggcgtcaatttcccggttgcgctcgatactgaccggcaagtgctggacgcgtacggcgtatcacctattccgacgacatttttgatcaatcccgacggaaaagtcgtgaaagtggtgaccggcacgatgacagaacgcatggttcatgactatatgaatttaattaagccggaggcgtcttcatgaaaaaggtcaaatgtgaatgcgggcacgtgaatccagccgggacggttttgtgcgagtcgtgcgggaagccgcttgatgatcaaaaatcgccgcttgccgatatgcggtacgacggcagcgcaaggcgttcgcaaacatataataaaacaatcgtagataaggtatggaacttcttttcttccgtaaaagtcggaatatggctgatcgtcattactctggcggcgtctgctttcggcacggtttttccgcaggaagcttatctgccgccgggcgcccagccggatacatattatgaacagcagtacggcataatcggccaaatgtattatctgttgggatttcatcacctgtacggctcatggtggtatatgctcctgatcgcatctattggcatatcactggtcatctgcagcctggatcgggtgattcctttgtacagggcgctgaaaaatcaaggagttcggcggaatccggtctttttgaagaggcagcgtctatacagccggacagaaaccgagctgagcggggatgcggctgatagcctcagaacacgattgaaaaaaaagcattatagagtgcgagaacaagagggcagcattctggcggaaaaaggccgtttttcaaggtgggggccctacgtcaatcatatcggcctgatcatttttctgatcggagccatgctgagatttgtacccggtatgtatgtcgatgaaacgctctgggtccgtgaaggcgaaaccgcccagatcccaggtactgacggcaaatattacttaaaaaacaaccggttcacgatgcagacatataacaaagacactgagaaaaaagtattcgccgacgccattgacagagccggaaacggcaaagtcgccaaatccttcacaacggacgcggttttgtataagagggaaggcgacattgtattcggtgaaaagccgaagcttaaaagagtcaaagaaaacaatatccgcgtcaatgaaccgctgcgctttgactcctattctgtgtatcaggtggactataaagaaaaccagctcgatcagatggtatttcacctgatcgaccaaaaaacaaaacagtcattcggcaaactgaagatcaatcttctcgatcccgacacggactatgatcttggtaacggttacaaagtgcagatcgccagttatcttcctgatttttattttaacaaggacggagaaccgagcacgaaaacgaaggttcctaacaatccggcttttgtctttaaaatcacggctcctgacaagccgaaaggggagaaaagttttgttgcgattcagcagactgttgaaggttccgaaagtaacaagtacaaattaaaattcgaccatgtggaaacgaaaaacattacaggactcaccgtcagaaaagacttaaccttatgggtgcttgccgtcggcggcgcgatctttatgatcggcgtcattcaaggaatgtactggcagcacagaaggatctggatcaaaacaggtgatcatgaagtgcttgtggcgggacatacgaacaaaaactggttcggtctgaaaaaggatatcgaatttgttcttagcgggaccgggattcaagagccggccgatcaaaaagaattggccaaaaatcaggcctagtgaaaaaggagtggtgtcatggcggagctgagcgcaaattttctttatgctgcctttttgatttatttaattgccgtcccggttttcggcggcgccatccggggaacaaaaggtgctaaggacggtaagggccgctggtcggctatcggaatcacgttaaccattttcggatttctttgtcatctcggctacttcattgcgagatggtcggcaagcggacatgcgcctgtcagcaatatgtttgaatttacgacgtcattcggcatgatgcttgttctcgcttttattattatttactttatttacagactgccttcattaggcatgttcacattgtctatcgcgcttttgcttatcgcatatgcaagcatgtttccgacagacatcacgccgcttattccgtcactgcagagcaattggctgtacattcacgtcacgacggcggcgctcgggcaggcgattcttgcgatcagttttgtagccggcgtcattttcctgttaaagcatgtcgaccaatccagaccgggcaaaaaaacgttctggcttgaagtcatcatgtttatactcgtgacgaccgtggcatttatcgccgtcacgtcggcattccggctggcggactacaaagctgaatttaattgggtggataaaaaagaagccaaaagcgtcatgatatatgatatgcctgcgcttgtcggcccgcatgagggagaactgcttacggaaggcgcaatgaagccgcttattgagcttccagccattttttcaggcagaaaggtcaatacggtgatctggtcgtttggcgcaggtctcgttttatacggtgcgctcaggctgatattcagaaagagaatcagcgctcttatcagcccgctcgtcaaaaatgtgaatctggacttggtcgatgaagtcggctaccgcgctgtttccatcggttttccggtattcacactcggcgcgcttgtgtttgcgatgatttgggcgcagcttgcatggacgcgtttttggggctgggacccgaaggaagtatgggcgctgatcacctttttattttacgcagcgtatttgcacttgcggctgtcaagaggctggcatggcgaaaagtccgcgtggcttgccgtcatcggcttcgccattattatgtttaacttaatttttgtgaatctcgtgcttgccggacttcattcgtacgcatagatgcaaaaagccgatacagttctcaagctgccgcacagtttgttaaaatgaaagtaacagaaggaaagcagggggaaaacgatggatcaaacaaatgaaactaaaatattagtagtagatgatgaagccagaattcgacgccttttaagaatgtaccttgaacgggaaaactatgtgattgaagaagcggaaaacggcgacgaggccattaaaatggggctggcatcagattatgatctggtgctcttggatttaatgatgccgggaacggacggaatcgaagtatgccggcagctcagagaaaaaaaagcgacgccgattatcatgctgacggcaaaaggggaagaagccaaccgcgtccaggggtttgaagcgggtacggacgattatatcgtcaagcctttcagcccgagagaagtggtgcttcgggtaaaggcgcttttaagaagggcttcccaaacatcttatctgacagccaataccccgacaaaaaatgtgctcgtcttttcgcatctatccattgatcacgatgctcacagggtgactgcggacggcacggaggtgagcctgacgccgaaggaatatgaactgctgtacttcctggcgaaaacaccggacaaagtgtacgacagggaaaagcttttaaaagaagtgtggcagtatgaatttttcggagacctcagaacggtggacacccatgtcaaacggctccgtgaaaaattaaataaagtgtccccgggagcggcgaaaaaaatcgtcaccgtatggggagtcggatacaaatttgaggtaggcgctgaatgaagttttggaaaagcgtagtaggaaagctttggtttaccattctttcactcgtgttaattgttttatttattttaacggtgctgcttctggaatttatagaaaattaccacgttgaagaagcggaaaaagatttaacgcagcttgccgacaaaattgcggtcataatagaaaatcatgaagaccagccgcttgccagatccatcacgtgggaactggcggacaatttaacgagcatcgcgatcattcaggatgataagcatgtctggtattcgcccaatgacgataatcatttatcctctattacattagagcagatcaaacatgaccgggatctgcacaaggcgctgacagaccgcaaaaaagtaagcaaacgcgcggtccccaacaatgccggttcggataacgaacggctgatcgtcggagtgccgtatgaaaaagacggcaaaaaaggcatggtctttttatcccaatcgctgcttgccgtcaaagatacgacgaaacatacgacacgctatatttttcttgcggcgggcattgccatcgtcttgacaacgtttttcgcgttctttttatccagcagggtgacatatccccttcggaaaatgcgggaaggcgcccaagacttggcgaaaggaaagtttgatacaaaaattccgattctgacccaagatgaaatcggggaactggccattgcctttaatcagatgggacggcagctcaatttccatattaacgcgctgaatcaggaaaaagaacagctgtccaatattttaagcagtatggcagacggggtcatcaccattaatatcgacggcaccattttggtgaccaacccgccggccgaacgttttctgcaggcatggtattatgagcagaacatgaacattaaagaaggagacaaccttccccctgaagcaaaagagctatttcaaaatgcagtgaacacggaaaaagagcaaatgattgaaatgacgcttcaaggaaggtcatgggttttattgatgtcgcctctttatgcggaatcacacgtccgcggcgccgtggccgtgctccgtgatatgaccgaagagcgcaggctggataaattgcgtgaagacttcattgccaatgtcagtcatgagctcagaaccccgatttctatgctgcagggatacagcgaagcaatagtggacgacattgcaagcaccgaagaggagaaaaaagaaatcgcgcagatcatttatgatgaatctcttcgcatgggccggctcgtcaatgatttgctggatttggccagaatggaatccggacatacgggcctgcactatgaaacggtaaacctgcatgaatttctggagaagatctcccgcaaattttccggggtagcgaaggaaaaaggcgtttcgctcacagaggacatctcagtgtctcagccggagtgtgtctttgatgaagacaaaatggaacaggtgtttaccaaccttatagataatgcgctgcgccatacggagtcaggcggaagcgttcatatcgcggctcagaccgtaaaagacggactgaagatcgatatcaaagattccggctctggaataccggaagaggacctgccttttatttttgaacgtttttataaagcggacaaagcaagaacaagaggcagggcgggaaccggactcgggctcgccatcgtaaaaaatatcgtggaagcccacggcggctcaattgcggttcacagcagcatcgacaaagggacgacgtttacattttatattccgacaaaagtgcaggatgacgtctgaaattgacgaacaatcttgttccatacgaaacacccgcatgttctgcgggtgttttttatttgtttctcctttaaaaatttaagaatatgttaatataaattcccttccaaattccagtttctcgtaatatagttgtaatgtaacttttcaacgcatttttacgacaaaaaagtgaacggaggggtttcccatggaagaaacctttcagatattatatgatgcataccatcaagatttatatcaatttttattttatatggtaaaagataagtcgcaggctgaagatttgacgcaggaagtgtatatccgcgtcttgaattcctatcatacatttgaaggaagaagcagtgaaaaaacatggctgttgtccatcgcacgccatgtggcgattgactggttccgcaagcagcagacgatcagacagcgtattatgggtacgtttgattgggatacacaagatgtcagagatcagcatttgcttccggacgaactcgccgtacagcatgaaaacgtccgggaaatttataccgcgcttgatcattgcactattgatcaaagagctgttattatcttgagatttattcagggatattccattcaggaaacagccgccgctctccgcttctcggaaagcaaagtcaaaacgacccaacacagagggctcaaaatacttcggaaacagatggagcttttgagggaggagctaatggatgatgaagtcatattggaacgaagaaagagtagaggagttgttaagacaacttccggcggttagagatcatcgttcacccgaggccatttaccggaatattgaaacgggtaaaccgtacaggaaaaaaccggcccgaagctggatcggccccgccgcagccggcgtctgcgcattgtgcatcgctctgattatatctcctcacctgatgacaaacaaatcttccggtgatcttaccgctgacagccgccagacagaaaaagccagtcagtcagcttctgtcaagccgccggatcagaagacgttcgtcgtctcaaaccaaaacaaaaacaattacattactttggcatttgccgattcagaaacatccgccgtcattccggtcagttttgaaaaaaagaagccggatgaatcggtttcagaggctttatccgaagcggaagacctagaagtgcccgaatccttcctgtctgtgccgaaccttttggacggtgtgcaggtaacggcggataagaaggatttgcttgtgcaggtaaacggacggctctctatcgaatcagttgccgatgctgacttattgaaaaagatgctgaaagagactttgacatggagcccttacgagcggattaaattgaaaaaggttcaaaacggagccggacaggatttttataaatcttacggcatttccgctgagatgtctgtacataaacagacaaaccgggcgtatttttcttacagcgacagtctgggacaagagtatctcatcccgtctgaacaaacctattattcagtatatcaggctattgacgggatgaagacaacagatgaaggctcacagactgcgagcattatagaagcagatgcgattgcatcggtatcggaaagggaagacggcgagcagctgcggattcaattgtccgaaaaacataaggttgaagattcgctggaagggattttaatgatcgaagggcttctgttaactgcgaaggaattcggttattctgaggtgctgttcacacatgcgcatacaaagaaaatcggtaattatgatgtgacaaaacctatcgctgtgcctgccgcgcctaatccgcttccaagccattaaacgtaaaaaaacccaaaacatatgaatgttttgggttttttgttggttacggaaggtcaatcagtttaacggaaacaatatcctgaattgaagtcagctcattgacgactttatcatctaaatgtttatcaaaagaaagcatcataatggcttctccgcctttttctttacggcctacctgcatggtagcgatattgatatcgttatcgccgaggatgcgtcctacgcgtccgattacaccggtcgtatcctggtgctggatataaacgaggtggccggcaggatttaagtcaatattaaagccgttcagttcaacgattcgttcaccgaagtgagggatatacgtagccgttaacgtaaatgtgctccggtctccggttacttttacgctgatgcagttatcatatcctgattcattggaggaaatcttctcgctgaagctgattccgcgttcttttgctacaccgccggcgttcacttcattgaccgttgagtctacacgcggttttaagaaaccggacagcaggctttttgtaataaatgaggtttcaagtttggcgatggtgccttcatattgaatcgcaacatctttgacgggttccttcatacattgtgacacgagacttccgattttatcggcaatttggtgataaggctggatttttttgaattcatctttcgtcatcgcaggcaggttgatcgctgacatgacaggcagaccttttgcaaactgcagcacttcttcagaaacctgtgcagcgacattcagctgtgcttctttcgttgaagcgcctaagtgaggtgtggcgatcaccagcggatggtcgggaagctttgattcaactggcggttccacttcaaacacgtcaagggcagcgcctgcgacatggccgctttccagcgcttccaaaagcgccgcttcatcaataatgccgcctcttgcgcagttgataagacggacgccttttttcgttttggcaatggtttctctgttaagcagtccttttgtttcctttgttaaaggcgtgtggacggtaatgatatccgcgctttcaagcacttcttcgaatgtccggctgtttacgccgattttaccggctctctcttcggttaagaaaggatcgaatacatgaaccgtcataccgaacgctctggcgcgctgggcaatctcgcttccgatccggcccagaccgacaatgcctaaagtctttccgtagagctccgccccgacaaaagccgtccggttccattctcttgattttactgagatattggcttgcggaatgtgtctcattaatgaagaaatcatcgcgaatgtatgctctgccgttgaaatggtgtttccattcggcgcgtttatcacgataaccccatgttttgtagcctcatcaatgtcgatgttgtctacgccgacaccggctctgccgacgatttttaaagaggtcatttttttaaacaattcttcggttactttcgtggcactgcggactaacagggcatcaaaggtatgtaattcatcttctgcatccgcgacgtttttttgaacaatttctataaagtctgattccatcagcggctttaagccgtcattgctcatcttatctgagaccaaaactcgaaacattgttagatttcctcctagtttagctgactaaatatctgataatttatcatattctcaatagagtgtcaatgtgtattgacgcagtaaaggagaaaaggaaaccgctgaatcagcttaaattgggcttccccaatattttatttaaatttgagcagttctctatacaattgcaatttgatcatatataatgtgaataaattcataagatcaatcttcggggcagggtgaaattccctaccggcggtgatgagcatcatgctctaagcccgcgagctgcttcggcggcaggatccggtgagattccggagccgacagtatagtctggatgggagaagatggaggttcagcagacgttttgatgcttatatcaaacgtttctttgccaagccttagtaagctcccgctttttaacaaaagcgggttttttattggggcgcaaaagaacctttcctcttttcgagagatttgatcgaaaaggagagagcattgtgaaagtagaaaaattagttgtcatcagtatgcttagcagtattgcttttgtgcttatgctgttaaatttcccgtttccggggctgccggattacttgaaaattgatttcagtgacgttcctgcaattatcgccattttggtttacgggcctgcggcgggggttgcggttgaagcgattaaaaatattctgcagtatatcattcaaggaagcatggccggcgtgcctgtcgggcaggcagccaattttatcgcgggaacgctgtttattctgccgacggcgtttatgtttaaaaagctcaattcggcaaaagggcttgcagtgagcctgctggccggaaccgcggcgatgaccgtgctgatgagtattttgaactatattcttatcctgcccgcgtatacttggtttttacattcaccggcactgtcaaacagccagttaaaaacggcggttgtcgcaggaattctgccgtttaacattgtaaaaggcgttatcatcaccattgtctttacgttcatctttacgaagctgaaaccttggattgaacaaaaacgcagcatccagacacaataaccactccaaagcgcccgctctgtaaaacacagaccgggcgcttttttgattgtttgatcacgcaaaaaaaataagactccggccgataacagccggagtcttattcaggacgaaaaagctcctctcacggggagggcttttttattcgtatttcagcgggtcgccttcgaacggttcatccgcaactttgattgaatcagtagggcatccttcaaatgcgtcaatcatatcttcttccagaacttccggaacttcgacgacgcctttattttcgtcaagcgtaacgaacgcaatgccttcatcatcataatcataaatgtctggtgccgcagctccgcaggcgccgcatgcaatacacgtatctttatctacaattgtgtactttgccatgaataaaacctcccagattgttcgtgttggaacaaatggtttaccttatatatttttaaatataacacctattcctcttacttattgtaatgatgttagtgtcaaatttcaacagaaaaatgattgagaatgcttatcacataagggattctctttagcacttccccctaaaagatgactttaaacgtcaaatttatatgaaaatctgttaaaataaaaagaaccaaaaaacgaaacttgtcacagaagaaatgtaggtgtgtttagattggcgataaactactttgataccgtggttctcgactgtctggacaaaatagacggcgaacggactccgagtgctgtgtttcatttattaaaaggaaaaaagtcgtctcaaaccattcaggatgccggcttatttcagatcgctaaatatttcggcatggcttcacattgtgaacgcggcgatattgcggcttctttgcataaactcaccgagaactcatacattacagccggaaaagaagagggaacgtggaaagtgactgcgcgcggcgttcaaaagcttgaacgggcgtttgccgagcggccttggccgaagcactgccacggcgcgaattatcaaacgcctgctgtcaccctgtggaggcggctttccctgctcattcaagtcctgtcaaacaaagagcatcaatgcagtcaatatatcccggttacaaacgatgtgcagacgctgagatgggtcaaacggttcatgcggaaaaacatagacgctaaagagctctccgtccaaatgcatgagacgctgtttcaccttctgcaaggcgtaagtgaacggcaggcgcttatttttgtctattctttaacttcattcaacagaatcggcaaaacgaataagcagcttgctctccagttgaacgaagatgaatggtatgtgtccgtccagttttggggagcggtacattatgttattcaatcgcttccgcaatgtgcatatcccgctctgcgcgagctgttgtccgatctgcaggcggaaagcgcgctgacacagtctgccagaaaaacctttgagctgttggaaaaagggtttccgattgaacggatcgccgcggtcagaaatttaaaaaccgccacaatcgaagatcatatcgtagaaatatcattgcatcagcctgcattttttacagaacagtatctttctgaagaggaacagcgtatgataacggcatttgcaaaacagcatcaaacgaataaaattaaacggattcgcgaaggaatgcagatgcgcttcagctattttcagatcaggctggcgctggcaaagacggtgaatcagcatgactgagctgcataaagctttatccaggtattttggtttgcattcctttaaaaaagggcaggaagagattatgactagcgtgctccaaaaaaaagatacgatcgccatgcttccgaccggcgggggaaaatcattatgctatcagctcccgggttacatgatggacgggctggtgctgattatttcaccgcttctatcattaatggaagatcaggtgcagcagctgaaagcgaaaggagaaaagcgggttgctgcattaaacagcatgctgaattccgcagagcggcattttatcctcagcaacatcagccggtataaatttctctatatgtctcctgaagccctttcttcaccttatgtgctgaaccgtttgaaaaatgtcccggtcagtttatttgttattgatgaggctcattgcatatcagaatggggacatgatttcaggcctgattactcgaagctcgggcctttcaggcaggcactcggaaagccgcctgtattggcgctgaccgcaacagcgacaaaagaaacgctcagagacgtgacggatgtgctcggacttgagcatgcggtgcgtcatctttattcagtcaaccggccgaacattctcctggcggcagaacatttggctgataataccgaaaaaataagcaggctcacggagcttgccgaaaagcttgaaggcccgggtatcatatattgtccgaccagaaaatgggcggaagagcttgcggctgagctgaacgaaaaaacgggaaagcggacggattattatcacggcggaatggatacaggcgacaggattttaatccagcagcaatttatccataaccagcttgattgcatttgctgcaccaatgcgttcggcatgggtgtggataagtcagatatccgctttgtcattcacttttatcctccccaaacggccgaggcctttatgcaggaaatcggcagagcgggacgcgacggcagcccgagtgtcagtattttgctgagggcgcccggcgataccgagcttcagcagcagattattcagacagaaagcctgtctgattatgacctggaaggcattctggccgtcatacgggatgccggtacgggtgatgaacgaaagcttcgggacgttctgatcaataagggagtccaggaaacacaggcgcgaacggccgtccatctgtttctgcaaggaaaaaccacaaaagaccagctgcgggaagaactgacataccgtgtggaaaagaagctgcgtaaaatgaatcgtttttcggcgttattagagcggaaagaatgtataagagaagcgctgctgtcttattttgatgaaccgtatgagcctgatggtcaaaccggacaatgctgcagcagctgcggacttgatctggctccgtacgagcaaaaaggagaacgtaaaaatatggaacggttagaagattggaagctggaattaggccggattttcggatcagagtctgcgggtgagttcagctgagacggcaaagcgaattgatccggcagctctcagaccgggagattgtgatgcagctgtacgccacccaattgctcatattggcggtttcagctgttatcggctttttcttttttaccgacattcacgattttttaaagctgtggcatatacgtgacgataatatcatatggtacggtgtaactcttgccgtccttgtcatttttgccgatctggcggtgatgaaatggtgtccttcgcatttatatgatgacggcggcattaatgtattgctttttaagaacaggccggttctgcacattttgtttttgacgcttctcatttcgttcagcgaagagattttgttcagaggcgttctgcagacacatatcggcttatgggccgccagcttcatttttaccgtgcttcatttcagatacttggcgaagtggcttctgtttatgatggttgcgggcatcagtcttttgctggggcttatctatgaatggaccggcaatttattcgttccggttacagcgcattttattattgatgcggtatttgcctgtcagatccgttttcaatatgttaggaggggtttgcatgacggaaatgtcaagagttgaaagaagaaaagctcagctgcgtgccgagcagcaggttgccgcggccgcggatgaacaaattgaatatcttgaagacagcctcccgacaagacaatctgtaaaagaggagcgtaaaaaaaaggaagagcaggtgaaggaaaaaaccaaaacaaaaacgccgctgttcacttttctgaccgtcctgttcattatcgtaacaatcggtgtctttttcggtcttctttatatgacgaacagcagcagatttgacccgaaggactatgaagatgtcttcatagaccacagtgaaagcgcgcctgccgttattccgaaaggcgctcagaaagaaacgtcagaaaccgctcttttagaacaaccgaaaaaaaagtctgacgacaaagataagaaagaagcggctgcacctgaaaaaacgaaagaaaaaccaattgaaaaaccaagtgaaaaaacacctgaaaaaacggaaacgccctcagaaaaacaagtaaagccgacagacaccgattacgcggagacaaaacagcagtctccgccggctgtccgtgaaaaagcggctccggctgaggcgagtgatcaagccgggactgtcccaaaaaaagtgcggaccgtacagcatactgtacagccgaaagaaacgctttaccgcatttcaatgaaatattataaaagccgggcgggcgaagaaaaaatccgcagctacaacggattaaacggaaacgacgtgtacaccggccaggttctgaacattccgctgtctgattaaaataaatgcatgttttcaccgcgtttttcatatagtgtaccaatgaaaacggacaaggtgtgaagcgcatggattctttatggaagcaattagaccgatttgctgacggaccgacgaaacaaatgcttcaggcgctggtgaaacggaaattaaaatacgaaaattatgccgcacaatgccgaagatggcagtgggcgtccctcgtttgtttttccctgatgtgcatactgctgatgtttaaaagctttaatgccccccaagcctctccgcagctgattctgcaggaaatattaggccatacggtttacttgtgctggattatggcttccgcttttgcgtattgcacttcttattatttcaaaaaaaaggaagaaaaagctgagggtgaatttcataaactgaggtgtgaaattatccaaaaaagcacggatttatggccccagcctgaaaaatggagggcgagagaatctgtttttcacttgatgaaacatcggtatgatatcaatctttattttgaaagcaaataaaatgaggcgttttccggaaaggatagaaacgtctttttttgtttgtccgtctaatataagacaatgacagaatggagagtgcgtttatgaagcttacagcgggaattctcggctcattggcgggagcggctgcggttatggcggccgttatgtacaaaacggcaaacggcagccatctgaaaacacatacatttacgcttgataaaatgaaggggatgaagccgctcaccatcttttttatatctgacgtgcaccgccgtttaattgatgaaaagcttctccgcgaagcggcaggttataagccggatgccgttttgctcggcggtgatttggcggagggcggagttccttacgccagaattgaagaaaacatcaaacgtctgacggctcttgcgcctgtcatgtatgtgtggggaaataatgattacgaggtcagccagcaaaaactgctctctcttttacgggcatataaagtgatcccgctgagaaatgaatcggttcagtttgcttataaaggggaaaccgttacgatctgcggcgtggatgatatcaggatgatgatggatgattacgatgctgcaatcagatatacggatgctgacaaagtaaacctcctgctttgccataaccccgacatccatgagcagatgagggagtcagacgggattgacgctgtgttcagcggccatacgcatggcggccaaatccgtttcggccggttcgggccgtacgaattgggcgggacgggaacggtaaaaaaagcgcattacctgatcagcaacggctacgggacgacaaaagttccgctgaggctcggggcgaaaccggagacgcatatgattacgctgtgcggaccggatgagccgtcttcctgaaacaaacccggccgcggtgataaaaaacggcattctgcttgtcttcccgctgtacacggtgtaaactgataacaaattaagaacctatgactcatttattcatatactgtgttatatgatttgtgtgcaagaagaggcaggagggaacattatgcggcttgagcgtctgaactataataagattaaaatctttttaaccctcgacgatctgactgatcggggactgacaaaagaagacctctggaaggactcgtttaaagtccaccagttatttaaagatatgatgaatgaagcaaatacagagctcggctttgaagcgaatggtccgatcgcggtggaagtatattctcttcaggcacaaggcatggttgtgattgtaacgaaaaatcatgacgcggacgcagaagatgacgaatatgacgatgattatatcgagatgcaggtcaaacttgacgaaagcccggatattatttatcagttccattcgtttgaagatatcattcagcttgccggaagccttcaccgaatcgggattaccggcggcaccgtctaccactatgagaaccaatactatgtaagccttgaagacctcggctcccgttccgccgaaggcgtcatcgcggtgctggctgaatacggacacccggcgacgattacgatttacaggctccatgagtacggaaaactcatcatggacggcaatgctgtggagaccatccagaaacatttttcataaaaaagatttgaaacggcagctgttttcagcggccgtctttttttaagcgaaataatggaaaaatcattgtctttcttctatgcacggagatattgaaggtgtatactagtcactgaaagggagcatgagagaaacagaagattttaggaggttaactcaaatggcagccgatcgattcaccggtcataatgaagaagacaaacatgatgtattaaaatcaacccaaaccgtaatacataaagctctggaaaaattggggtatccagaagaagtgtatgaactgctgaaagagccgctcagattattaacggttaaaattcctgttcggatggatgacgggtctgtgaaaatatttacaggctatcgtgcgcagcacaatgattccgtaggtccgacaaaaggcggcattcgttttcacccgaatgtaacggaaaaagaggtgaaagcactttccatctggatgagtttaaaatgcggaattattgatcttccttatggcggtggtaaaggcggaattgtttgtgatccgagaaatatgtcattcagagagcttgaaaggctgagcaggggatatgtcagagcaatcagtcagattgtcggaccgactaaagacgtcccggcacctgacgtatttacaaactcacagattatggcttggatgatggatgaatattcaagaattgatgaatttaactcacccggctttattacgggaaaaccgcttgtactcggcggatcccacggcagggaatcagcgacggcaaaaggcgttaccatctgcataaaagaagcggccaagaaaaaaggtctcgatattcagaacgcgcgcgtcgtcgtacaaggtttcggaaacgcgggcagctatctggccaagtttatgcatgacgccggcgcgaaagttgtcggaatttctgacgcgtacggaggcctttacgatccggacggtcttgatattgattatctgcttgaccgcagagacagcttcggaacggtgacgaagcttttcaatgacaccattacgaatcaggagctgcttgagctggactgtgatatacttgtcccggcggcgatcgaaaaccaaattacagaagagaacgctgaccgcatcaaagcgaaaatcgttgtagaagcggcaaacggaccgacgacactggaaggaacgaaaatcctgacagacaaaggaacgctgctggttcccgatgttctggcgagcgccggcggtgtaacggtttcttatttcgaatgggttcaaaacaaccaaggcttctactggagtgaagaagaagtcgaggaaaaactggaaaatatgatgataaaatcgtttaataatatttatgaaatgtcccaaaaccgccggattgacatgaggcttgcggcttacatggtcggcgtgcggaaaatggcggaggcttcgcgtttcagaggctggatataaaccaatcgtttgcataaacaaaaaaaatctcctatgataatataggagattttttatatgagtggaaacttatgatggaaatgccaatcgcaggagttgaaggacatgacagaagaaaaagcaattataataggcggaggtccttgcggattatcggcggctatacatctgaagcaaattggcgtgaactcgcttgtgatcgaaaaagggaatgtcgtaaacagcatttataactatccgacccaccaaacttttttcagttcaagtgaaaaattggagatcggcgatgtcgcctttattacggaaaacagaaaaccggtccgcatacaggctctctcttactacagagaggttgtcagaagaaaagagctgcgcgtaaacgcctttgaaacggtggagcgcgtaacgaaacaggaagacggccgttttcttgtagaaacatcaaaagaccgctacctcactccgttttgtatcattgcgacaggatattatgatcatccgaattatatgaacataccgggtgaagggcttcctaaggtatttcattactttaaagaaggccatccttattttgataaagatgttgctgtgatcggcgggaaaaactcaagtgtggatgcggctttggaactggtgaagtccggtgcgcgcgtcacggtgctctacagaggacatgagtactccccgagcatcaagccgtggattctgcctgagtttgaggccctcgtcagaaacggcacaatccggatggaattcggcgcttgtcttgaagaagtgacggaagatgaaatcattttccgctccggccgaaatgagacggtccggctgaaaaacgatttcgtatttgccatgacgggataccatcccgatcacggtttcctcgaaaaaatcggtgtgcggattgatgcggaatcaggccggccgtttttccgggaagaaacgatggaaacaaatgttgacggtgtttttatcgccggagtcattgcggctggaaataacgccaacgaaatttttatcgagaacggccgttttcacggcggcttgatcgcaaatgaaatatcaaaacggctgggtgcagagagcatatgatcattcatatgctcttttttaaaaaaattgaaagatgtaaaaatatgaacaacatggtacgatagatataggaatataaaggaaagaggttgcctgatgtttgcaatcatctctgcaggaattgctcccggcattgcgctgttaagctatttttatttaaaagatcagtatgacaatgaacccgtacatatggtgctgaggtctttttttctcggggttgtccttgtgtttccgaccatgtttatccaatatgttcttgaaaaagagcatgtggggggaggaagctttttcgtttcgtttttgtcttcgggatttctggaagaatcggtgaaatggttcgttctgatgatcagtgtgtatccgcatgctcattttgatgagcattatgacggaatcgtttacggggccagtgtgtctttaggatttgccacgcttgaaaatattctgtatctattcggccacggtgttgagcatgctttcatcagggcgcttctgccggtctcctgccatgcgctgatcggagtgattatgggattttatctcggaaaagcccgcttttcgcagaaaaaagcccgtgtcaaatggcttgtgatttcgctggccgtgccttcatgtctgcacggttcttacgattttattcttaccgccctcaatcattgggtatattatatgctgccgtttatgctgtttttatggtggttcgggctgcgaaaggcaaaaaaagcacgctccgtcaatatgatccaagtgtgaagaaaccgcgcgtcgcgtgcggtttcttttttatgccttgacaggggataagaaggaaacgtgcataaaaataacctcgtgacagacaatacgggtacactttaaattttgcagtaggaggcttgaagagatgaagtgcaaaggagcctttatggcatgtctcattctattttctttcgccgccgctttcttcgatcatcatgaaacggttcatgcgttttcaaatcaagtgattcaaagaggcgcgacgggtgatgatgttatagaattgcaggcccgtcttcaatataacggattttataacgggaaaatcgatggtgtttacggctggaccacatactgggccgtgagaaattttcaggagaaattcggcatgaaaccggttgatggcctcgtcggcgcaaaaaccaaacaggtgctgatttcaaaatcaaaatattaccgtgaatatgtaatggagcagatccaaaaagggaatacgttcactcattatggcaacgtcccattggaaaaccaaacaaaaccgagagccggaacgcagaagccggcgggaacgaataagcctgctcaaaagccgcaaaacaatacaggcggtcagtcaaatcaaaagcaaaatacgacagcggccaatatgcctggcggtttctcaaacaacgacatcaatcttctggcacaggctgtgtacggggaagcacgcggtgagccgtttgaagggcaggttgccatcgccgcggttattttaaaccgtattaaaagcccgttatttccgaatacggtggccggcgtcattttcgaaccgctcgcgtttaccgccgttgccgacggccaaatatatatgcagccgaatgaaagagcaaaagaagcggttcttgatgcgatcaacggctgggatccttctgaaaacgcgatttattatttcaatcctgatacggcgacaagcaaatggatttggggacgtccgcagataaaaagaatcggaaaacacattttctgtgagtaaaagtacgcaaaatgaggtgttaacatgattagaggaatcattatcgctgttctcggtgtcgcgatcgccgcaaccggatactggggatataaagagcatcaggaaaaagatgcggtccttctgcatgcggaaaataattatcagagggcttttcatgaattgacgtaccatgtagatcagcttcacgacaaaatcgggacgacgcttgcgatgaacagtaaaaaatctctgtctccggcgctcattgatgtatggcgaataacatctgaagctcataacaatgtgagccagctgcccctgactctcatgccttttaataagacggaggagtttttatccaacataggagatttcagctataaaacatccgtccgggatttagatcaaaaaccgcttgataagaaagaatatacaacactgaacagcctgtacaaacaggcggagaacattcaaaaccagctccgcagcgttcagcatctcgtcatgagcaaaaatttacggtggatggatgttgagatggcgctcgcctctgacaaaaaacaaagcgataatacgatcgtcgacagctttaaaacagtcgaaaaaaatgtaggcgctttttctgaagacagcatcagccccacatttacgggagcaaatacagaacgaaaaggttttacgcatctgaaaggaaaacaaattacggaaaaagaagcggtcaaaatcgcgcaacggtttgcgcctgatcataattattcaattaaagtggtcaaaagcggcaggaagacgaatcgggacgtatacagcatccgcatgaaagacgccgacaacaagtcttttatctatatggatattacccaaaaaggcggacatccggtctatttgattcaaaaacgggccgtgaagaaacaaaagatcagcctcaatgaagcatctaaccgggccgtcgcgtttttaaagaaaaatggatatgaaacaaaaggcctcgaaattgatgaaagcgcgcaatataataacatcggcgtcttttcttttatccccgtggagaaaaatgtccgcatttatccggaagccatccgaatgaaagtggcgctggatgatggtgaagtcgtcggtttttccgcgcgtgattacctggcggcgcaccgcacgagaacgattccggctcccgctttgtcagctgatgaagcgaaagcgaagctgaataaaaatgttgaagtgcgggagacccggcaggcgctgatcacgaatgagctcggtcaggaagtgctttgctacgaaatgctcgggacgatcgggaaagacacatatcaaatgttcattaatgcggacgacggaaaagaggaaaaaatagaaaagttaaaaagtgcagaacctatatataaagacctataaaaataaaggaggaaaggactaaaagtcttttcctttttttcgttacatgctttaataaaagcataaataatgaaagagtgaaggcccatgatagctgtcggagattatatttggattgaatacatagagaacaatgagcccaaaaaagcgaggagcaaagcagtaagcgttgaaaacggcgaactgcacatctcatatcccgtcgatctggattcgggacggacggtctttttgcataaaggattggaaataacagcggaatttatggggaatggccacgtaccgtatcaatttaaaagcataatcaaaggaaagaaaaaagaccccatcccgatgatcggattggacatcccccctcaggaggaaatgaagcggattcaaagacgccgatacgtccgtgcagacgcagtattggatgtatccgtcaaaatggaagcgaaaaaaaccgctttccatacggtttcctctaatatcagcgccggcggaatcgctgttgtgatgcctgagcatatttccgcggaaccaggtgaaaagctgtatgtctcattttctcttcccggcaaggaaaatacagccgatattacggccgaggctgttacccagcggattttttatgatgaaaaggcggataaacaaaaaatgacgcttgaatttgcagaaatcgatcccgcttcacagcagcttttactccaatattgtatgcgcgcgcagctgcagcagagaagaaacagtctgtcggaataaacagcagcgcacttttccatactaatcctaatggaggtgcgcgtgtatgaaaacgtttgaacgtctgctggtcaaattggtctgcattcagcttatcattttgggcgcggtgcaatttttgcttcattatcagcctattgaaccttatatttcgaaagctgtgaaatatgagggagttgataaaatggagaaaaaagaatggattgaaacggtaaagcggtaaatcagctcaattttttcgccccttttccggcagttcatgatacaatccatagaggagaaaagagcaaggagagagattatggacaagaaattatcaattgcgatcgacgggccggccgctgccggaaaaagcaccgttgctaaaatagtggctgagaaaaaatcatatgtgtacattgatacaggagcgatgtatcgtgccattacatatacggcgctcaagcagaatgccgatttaactgatgaagccgcgcttacagagctgctgaagcgtacggaaattgagcttgtatccgctccggaaggacaaatcgttctggtaaacggagaagatgtgacagaagaaatccgaaaagacgaagtcagcaaccaagtatcaatcgccgccaagcataaaggcgtcagagaagaaatggtcaaaagacagcagcagctcggacaaaaaggcggtgtcgtcatggacggccgtgatatcggtactcacgtgctgcctgatgccgaagtgaaaatttttctgctcgcgtccgtagaggaaagagcgaagcgccgatatgaagagaataagaaaaaaggctatgacgtgaattacgagacgctcattgaagaaattgccagacgcgacaaactcgattcagagagggaagtttccccgctgcgcaaagcggaagacgcgattgaaatcgatacgacgtcactcagcattgccgaagtcgcaggaaaaattctggagatcgtcgaacagaaatcacgttaacttcgggtggagcgctttataatttttttcgaagacaagatgttattgcttgacaaaccagtccatttattagaagttaatactaataaaactttttattgatcattcaaaatcttttttggatgattctttaatacatattcggctgaaaagcggacattcacatgttcagctttcaaaccgtattaattaagctgtgtaggtttggaccaaggaggttattcaaatgacagaggaaatgaatcaaattgatgttcaagtgccagaggttggagatgtagtaaaagggattgtgacaaaggtagaggacaagcatgtagatgtcgaaattgtcaatgtcaaacagtccggaatcattccaatcagtgaattatcaagtcttcatgtagagaaagcatcggatgtcgtaaaagttgacgacgagcttgacctgaaagtaacaaaagtggaagacgatgctttgattttatctaaacgtgccgttgatgctgaccgcgcttgggaagaccttgaaaaaaaattcgacacaaaagaagtgtttgaagctgaagtgaaagatgtggtgaaaggcggtctcgtcgttgatatcggcgttcgcggcttcattcccgcatcacttgtcgaagctcatttcgtcgaggatttcactgactataaagggaaaaccctctctcttatcgtcgttgaactcgaccgtgataaaaaccgggtgattctgtcacaccgggctgtagtggaaaaagaacagacagccaaaaagcatgattttctccaaacgcttgaggttggaagcgtgcttgaaggaaaagtgcagcgtctgactgatttcggcgcatttgtcgacatcggcggaattgacgggcttgttcatatttcgcagctgtctcattcacacgtcgaaaaaccgtctgacgtggtggaagaaggtcaggacgtaaaagtgaaagtactgtccgtagaccgcgataacgaacgtatttctttatctattaaagaaacgctgccgggaccttggagccagatcggcgaaaaggtaaaacagggagatgtgcttgaaggaaaagtgcagcgccttgtaagcttcggcgccttcgttgaaattcttccgggcgtggaaggacttgtgcacatttcgcaaatttccaataaacatatcggaacgccgcatgaagtgcttgaagaaggacagactgttaaagtgaaagtgcttgacgtgaacgaaagcgaagagcgcatttccttaagcatgcgtgagcttgaagaagcgccgaaagccgatcaggaggacttccgccaataccaggcgaaagaagagccgagcaccggcttccagcttggcgatttaatcggagacaagcttaataaattaaaataaattggtgataaaacgtgacacgagcagaacgaaaaagagaacatataaatcatgcgctgtctaccggccaaaaccgggaaacggggcttgatgatattacgtttgttcatgtcagcctaccgaacctagcattggaaaaagtggatatatcaacgaaaatcggcggactcacaagcagttcgccgatttttatcaatgcgatgacaggcggcggcggacaacttacatacgaaattaacagatcgctggcaagagccgcgcgcaaagccggcatgccgctggctgtcggttcgcaaatgtcagctttaaaagatccctccgaacggtgttcttacgagatcgtcagaaaagagaatccggatgggctggtatttgccaatttaggcagcgaggcggatgccgagcaggcgaaaagggcagttgatatgattcaagcagatgccctccagattcatttaaatgtgattcaggagatcgtcatgccagagggtgacagaagctttactggcgctctcggccgtattgagcggattgcggcggaagcgggagttcccgtttttgtcaaagaagtcggcttcggaatgagcagggaatcggcacggcagttatttgatgctggcgcagcagcagttgatgccggcggatacggaggtacgaatttctctaagattgaaaatatgcgcagagagaaggcgcttcatttttttaatacgtggggaatttccactgccgcaagcttagcggaaatccactcgctctccgctgatcaatcaattatcgcatccggcgggctgcaaagcgccctggatgtcgccaaatcgattgccctcggcgcttccggcgcgggaatggcgggcactttcctgaaagctctcacctctaaaggagaagagggcctgtttgacgagatgacggcgcttttacaagagctgaaaatgattatgaccgccctcggatgccaatcggtttcccaattgcaaaaggcgcctttggtcataaaaggtgagacacatcactggctttctgaacgggggattgacacgtcccgtttcagcagacgttaaaaggcatgcgaacccgcatgcctttttctgttttttacgattttctttttcggaattccccgttttgctcaaggcttgtcgctcctttatggtgaatcgaatcatcgcgatcagattccacccgtcgggaggctttcagttttttctcctgtctgtcttttcccatccttatccgctcctttcagtcataattggtttaaaaaatgcgttcccgctccatactggtcagaggaggagcgattatggaaccgttttattattactggtcaatgtggtttttatggatacttgcgacttttatttttgccaaaacaaaaagccgcttttacgtatcagtctttattttgactaatatgatggcaagcatacatcagattacggcttattttacgctgaacgcggcatatgtcatgttttttgctgcggcatttgtttatgcgggaagcctcggcatgcataaacggctccgtaatattgtgattcatctgacggcggctgcggcgtacggctttatttttctttttgcattatatgaccctgtttggtttatcataaaacctgaatgggcggcggttatactgcttaccgttattacgctttccgttgaggggcggttccctgagaggctttgtctttttgttctcggcatgtgccagggggagctattgtatgctgcggtcatccgcaacattgcgggtgcagcagccgtcggtgattataaatggctttcaggctgttcggcgggagtgattcttctcgtcgggctgactacatatgaacagcttgcggcgcgcatcagccaaaaaagcaaaaagcagggcaaaggagcgacaaaaatgtcttgaaaacagacggagactgttacatgaatgcgaaacattttgaagaatacattgtgatctcagtgaaaactgatataataaatgagttaagcccttctgtttgaagggttcttttcatagcgaagatgatttttaataaccggttgaacaattttttgtgaaaatgtaagcggctggattgaaaggaagggtactatgggtaaacctgtcgtagccattgtcggaagaccgaatgtgggaaaatccacaatctttaaccggattgcgggtgaaagaatttcaatagtagaagatacccccggagtgacgcgggaccggatatacagttcggcggaatggctgaattatgattttaacctgattgatacgggcggaattgatatcggagacgaaccgtttctgacacagatccgccagcaggctgaaatcgccatggacgaggctgatgtgatcatctttatggtgaacggccgtgaaggtgtgacgtctgcggatgaagaagtggcaaaaatactgtaccggacgaaaaaaccggtcgtattagccgtaaataaattagataataccgaaatgagagcgaacatctatgacttttatgcgctcggctttggagaaccgtatccgatttcgggcacacacggtttaggattgggagatttgctcgatgcttgtgccgagcattttaaaaacattccggagacgaagtacagtgatgatgtcgttcaattctgcctgatcggccgcccgaatgtcggaaaatcatcccttgtcaatgcgatgctcggcgaagagcgggttatcgtgagcaacgtagccggaacgactagagacgctgtggatacggcgttcacctacaatcagcaggaatttgtaatcgttgacacggcgggaatgagaaaaaagggtaaagtatatgaaacaacagaaaaatacagtgtgcttcgggcgttaaaagccattgaccgctcagacgtcgtcggcgttgtgctgaatgcagaagaaggcatccttgagcaggacaagcggatcgccggatacgcccatgaagccgggaaagccgtcgtcattatcgtaaacaaatgggatgccgttgataaggacgagcgcacgatgaaagaatttgaacagaatattcgggagcatttccaatttctcgattatgcgccggtgctgtttatgtcggcactgacgacaaagcggattcatacactcatgcctgcgattattaaagcgagtgaaaaccactctctccgcgtgcagacaaatgtcttaaatgatgtcatcatggatgcggtcgccatgaatccgactccgacgcacaacggctcccgtctgaaaatttactatgcgactcaagtcgctgttaagccgccgagcttcgttgtttttgtcaacgatccggaactgatgcatttttcttatgaacgctttttagaaaaccgaatccgggacgctttcggatttgaaggtacgccaattaaaatatttgcaagagcaagaaaataaaaaggtgtgatacagagatgaaaaaagtggcaatgcttggagcgggaagctggggcactgcactttctttagtgctggctgataacggacatcaagtcatgatgtggggacaccgtgccgaattgatcgatcaaatcaacgaactgcatgaaaacaaagattacctgccgggggtggagctatcaagttctatcatcggtacagctgatttaagcgaggctttaaaaggagctgacttcatcattgtggcagttccgacaaaagccattcgggaagtgctgaaaaaggctctgccgtacatcccgaaacaatcgatttttgttcatgtcagcaagggaattgagccggattcgcttctccgcatttcagaattaatggaagaggagctgcctgaggagtacagaaaagacatcgtcgtgctttcagggccgagccacgctgaggaagtcggattaagacacccgacgactgttacatcatcttcaaaaaatatcaaggctgcagaagcggttcaggatttatttatgaaccagcatttccgcgtctataccaatccggatatgatcggtgttgaaatagggggagcgttaaagaatatcatcgctcttgcagcggggattacagacggattgggatacggagataatgcaaaagcggccttaatcacccgaggtcttgctgaaatcgccagactcggcacaaagatgggcggaaatccgctcaccttttccggcctgaccggcgtaggcgatttaatcgtgacgtgtacaagcgttcattcccgaaactggcgcgccggcaacctgctcggcaaaggatacaagctggaagctgtcctggataagatggggatggttgttgaaggcgtgcggacgacgaaagctgcgtatcagctgtctcaaaaataccaagtgaaaatgccgatcacagaggcgcttcaccaagtattatttaacgggcagaaggtagaaacggccgtagaatccttaatggccagagtgaaaacccatgagatggaagacttggtcaacacattcgaaaaccgggtgaagtgacaataacatgccgtcagcatattctgaagtgacgaaagtccaaaacgcagaactctccggctgaaatcgcttaaaacatttgctgatttaggcagaagaggatgcagacgtatgcatctgcgcatactatagcatcgaagtccaagagagtgtatctcagacgtacaggtgaatatagtcaacttgactgaagcaaagtccccctctttgcttcagtttttttgttttttcaatagatggaaaacctgttgatcttttcaacatttgtatattaaaatgaaatataacgcttacaatgatgggacggggggcacgaacgtgagtgtggcattgatgaaaatgtggtttgcgcttggtgcgatgggattaatgtttgttgcggtggcctctatttatgtcagcaggtacaaagtgaaaaacaaactgataaaagcagcggtttcttcactcgcttatgcctgcatggtcatctcgggattgatcgtgttaatggtcgttttcagcgggcctgtcaatgaataaagcaaaaagggggcgcggaatgcataagttaaaaatggccgtcataacggcaatggcggtgcttctgctgtccggctgtctgtaccctgaagcggaaaaaactgaaaataaagtatcttacaaacatcagcttcagcaggtgcaagcggcagtggatgaatttaaaaaggcgaacggcggacttctgccgattcagacaaaagatatgaaaacaccgctctatcaaaaatatccgatagattttaagcggctcgcgcccagatacatagaggagccgccggcctcagcttatgaaagcggaggaatgtaccaatacgtgcttgtcgatgtggaaaataggccgaccgtcaagctggtcgatctccaaatggcggaagcaatccgcgacatgaagctgcgtgtcaaaatgtatcaggaaaagcatacatatcctccctatgaggacgccgtttcaaaagggctgttcactttaaataaaaaaaagctcggcatgaaagactctccttcagtcaaaagtccggtttcaggcacgtctctgccgcttttaatcggcgctgacggagaaatctatgccgactatcgcgtcgatctcgcccgctgcctgaaggaaaacaaaaagaaaatcaaaccgggcgcggaaattcaggatattttatggaaagagactcctttcgtcccggccttttcagtcacatacaccgtaaatgaaaaacaggaacccgtttttttagaaagtcaaacgaaacaggaatgaacctttttcccgcgcatacaaatagggagaaaggttttcttgattttgatagaaaagactgcctgaaaattttctaaagatgtcatattgaaataggacaacgtcatacacatatagtgtcctgtatttgattggagaatggtgaatgaaaaatgataaggataggaagtccgggaggggatcacttggaaaaggtcgatattttcaaggatatcgctgaacgaacagggggcgatatatacttaggagtcgttggcgctgtccgtacagggaaatctacattcattaaaaaatttatggagctcgtggtgctcccgaatatcagcaatgaggccgatcgagcgcgggcgcaggatgagcttccgcaaagcgcagcaggaaaaacgataatgaccacagaaccaaaatttgtcccgaatcaagccatgtccgttcatgtcgcggaaggacttgatgtcaacatccgtcttgtggattgtgtgggatatacggttcccggggcgaagggatatgaggatgaaaacggcccgagaatgatcaatacaccttggtacgaagaaccgattccctttcatgaggcagcggaaatcggtacgagaaaagtcatccaggaacactccacaatcggggtcgtcattacgacagacggctcaatcggcgatattgcgcggggcgattacgtggaagcggaagaaagagtcatcgacgagctgaaggaagtcggcaaaccgtttattatggtcatcaactcggtaaaaccgtaccacccggaaacagaagcgctcagagctgaattaagcgcgaaatatgatattcccgtcctcgccatgagtgttgaaagcatgcgggaaacagatgtgttaagcgtcctcagagaagcgctttacgagttccctgtgctggaagtcaatgtcaaccttccgagctgggtcatggtgctgaaagaaaatcactggctcagagagagctaccaggaatcagtgaaagaaaccgtaaaagatattaaacgcctgcgcgatgtcgaccgggttgtcggccacttcagtgaatttgagtttattgaaagcgccggattggccggaatcgaacttggccagggtgtcgcagaaattgatttgtatgcgccggatcatttatatgaccagattttaaaagaagtggtcggcgttgaaatccgcgggaaagaccacctgcttgaattaatgcaggacttcgcccacgcgaaaaaagaatatgatcaggtatcagatgcgctgaaaatggtgaaacagaccggctacggcattgccgccccggccttagccgatatgagccttgatgaaccggaaatcatcagacagggatcaagattcggagtaaggctcaaagcggtcgctccgtccattcatatgatcaaagtggatgtggaaagtgaattcgcgccgatcatcgggacggaaaaacaaagtgaagaacttgtccgttacttaatgcaggactttgaagatgatccgctttctatctggaactccgatattttcggcagatcattgagctctatcgtaagagaaggaatctccgcaaaactgtcactcatgccggaaaatgcgagatataaactgaaagaaacgctggagagaattattaacgaaggctcaggcggcctgatcgccattattttgtaagctgaaggacctcttcctgaaacggggggtctttttttattctttttagatactggaaatcaatcaaggattaggaggaaaaaagcaaaaaaaggaatatttgttcggtgaaacacgtgaaaaccttgacgagcaagggattgaggctttaaaatgcttgatatggctttttatatgtgttactctacatacagaaaatcttcactttgttggacaaacattcctcaaagtgtctgttttcttttgaaaagccgtttacttgtctgttcttccctgctttgattttttatcagacaggtttagaatcaggctgaactgtgaagaaatgataataaactgctgatttgatacccttttgggaggaggtgaaaggcatgaacaagacagaactaatcaatgcggttgctgaagcaagcgaattgtctaaaaaagacgctacaaaagcagttgattctgtttttgatacgattttagatgcacttaaaaacggtgataaaatccaactgatcggtttcggtaactttgaggtgcgcgagcgttctgcacgtaaaggacgtaacccgcaaacaggtgaagaaatcgaaatccctgcaagcaaggtacctgctttcaaaccaggtaaagctcttaaagacgctgttgcaggaaaataattgtgaatatagatcgtgtatgcatctgatacatacactttgtttcttcacagaaaagccccttgataaaggggcttttcatatttaagcagcctcggtcaccgggcaggactttcgttttgcttttggcgcggcaaatgtgctagaatcgaaattaaatgtattcaatggtggaggacacagacaatgaaagaagttaataaagaacagattgaacaggcggttcgccagattttagaggcgattggagaagacccggaccgggaagggcttttagatacgccgaaacgcgtggcaaaaatgtacgcggaagtattctcgggattaaatgaagacccgaaagaacactttaaaaccgttttcggagaagaccatgaggagcttgttcttgtaaaagatatcgcgtttcattccatgtgtgaacatcaccttgttcctttttacggaaaagcgcatattgcctacattccgcgcggcggcaaagtgacaggcctgagtaaattggcgcgggcggtggaagccgtctcaaaacgcccgcagctgcaggagcgcatcacttcaacgattgcagaaagcatcgtagagaccttagatccccacggcgtcatggttgtcgtcgaagctgagcatatgtgcatgacgatgaggggcgtaagaaagccgggtgcaaaaacagtgacttccgctgtaagaggtatttttaaagatgacgcagcggcgcgttccgaagtgttagaacatattaaacgtgcggattaataatgatagagggtgcagatatgaattcaaagcattcaagtgattttgtcgtcattaaagcggtcgaggacggcgtgaacgtcatcggtttaacgagaggaacggatacgaaatttcaccattccgaaaaactggacaaaggcgaagtgattatcgctcagtttactgagcatacctctgccatcaaagtgagaggcaacgccctcatccagaccgcttacggagaaatgaagagcgaaaaaaaataagccggctgtttcccgcttttgccaaatgcccgcaaacggcgggagaatacagccaatttcttttttttatgctataatgatacctgcgtataataatgacgagtaaatctcatacatattagaataaatgtgaatttggggacaagggtgatatttttgcaagacatctacggaactttagcgaatctaaatacgaaattaaaacaaaagctgtctcatccttatttagcgaaacatatttctgcgcctaaaatcgatgaggataagcttcttctttttcacgctttgtttgaagaggcggacattaagaacaacgacagagaaaattacatagtaactgcgatgcttgtccaaagcgcccttgatacccacgatgaagtgacaacagccagagcgttaaagcgagacgaaaataaaaaccggcagctcaccgtgcttgccggcgactatttcagcggactgtattattcgcttttatctgaaatgaaggatatctatatgattcggacgctcgctacggcaattaaagaaatcaatgagcataaaatccgtctgtacgatcggtctgtcaatgacttgaatcaattgatcgaaagcatggcgattgtggaagcggccctgtttcacagagtgtcagaccactttaatcttccgcgctggaaagagctggcgagtgatttttttgtatataagcggctgatgaacggcaatgctatatttctcgatgtcatcggcaatattgtaaagtcaggaaaatcaaaggctgacataatggaagatagcttccgaaaggcaaagcaaagcattgaaacgctgctgccgctcaattcaccaatccaaaacctaatgctgaaccggcttaaagcgatcagccaggacaaaacatatcatcagaaagtggaagaagggtaatcaacatgcaggagtcaaaagaacagcgcgtacacggcgtgtttgaaaaaatctataaaaattatgaccaaatgaactctgttatcagttttcagcagcataaaaaatggcgcgataaaacgatgcagatcatgaatgtaaaagaaggcgcaaaagcgcttgatgtctgctgcggaactgctgactggacgattgccctcgcagaagcggccggaaaaagcggcgaaatcaaaggactggatttcagcaaaaatatgctgagcatcggtgagaaaaaagtgaaagagggcggttacagccaaattgagcttttgcacggaaatgcgatggagcttcctttcgctgatgattcttttgattttgtcaccatcggcttcgggctgcggaacgttcccgactatctgaccgtgctgaaagaaatgcggcgggtcgtcaaaccgggcggacaggtcgtatgtctggaaacatcccagccggaaatgttcggattcagacaggcatattttctttattttaaatacatcatgcctttcttcggaaaaatgtttgcgaagagctataaagaatattcttggcttcaagaatcggcaagagaatttcccggtatgaaagaacttgcccgtctgtttgaagaagcgggcctgacgaatgtcaaataccattcgtttaccggcggagtggctgctacgcatatcggttggaaatgatgaatatacagatgtttgggtgaatgatatgaaatttaaaatggcctattcttttttaaatgacgatattgatgtgatcgaaagggagcttgagcaaacggtgcggtcagactatcccttgctgagtgaagccgggctccacctgctccaggcgggcggcaagcggatccgccctgttttcgtattgctttccggcatgttcggcgactatgacattaataaaataaaatatgttgcggtgacgctggaaatgattcatatggcgtccctcgtgcatgacgacgtcattgatgacgccgagctgcggaggggaaaaccgaccatcaaagccaagtgggacaaccgcatcgccatgtataccggtgattatatgcttgcgggctcacttgagatgatgacgagattggatgagccgaaagcccaccggatcctgtccaaaaccatcgtagaagtatgcctcggagaaattgaacagatcagagataaatacaatatggagcaaaacctcagaacctatttgcgccgcattaaacggaaaacggctcttctcattgccgtcagctgccagctcggcgccatcgcttcgggagctgatgagaagattcacaaagcattatattggttcggttattacgtgggcatgtcctatcagattattgacgacattcttgatttcacctcaacggaagaggaactgggaaaaccggtcggaggggatctgctgcaaggaaatgtcactctgcccgttttgtacgcgctccgtcagcctgaattgaaaaatcagctgaaattaattaacagtgaaacaacacaggagcagctcgcccccattattgaaaatattaaacgcacagacgcgattgaaaaatcaatggccgtcagtgacaggtacttaaaaaaagcgtttgaaaaactgaatacactgccgagaggacgtgcgcgctcatcattggccgccatcgccaaatatatcggcaaacggaaattttaaattcctttttacgaacaagatgtgaacattctccgccctggattgattaattgtcagaaagatgttacgatttcggtgtgcaacttgaaagcctatacataatgatggggtggagaatcttatggaaaaaacttttatcatggtaaaaccggacggcgtacagcgccagctgatcggagagattttatccagatttgagcgtaagggcttacaattggcaggagccaagctaatgcaagtttcagaacagatggctgaaacccattatgctgaacataaagggaagccgtttttcggcgagcttgtggaattcattacatcaggacccgtatttgcaatggtatgggaaggggaaaatgtagtagagatcacaagacagctgatcggaaaaacgaacccgaaagatgcactgccgggcacaatccgcggtgactacggcatgtttgtcggcaaaaatatcattcacggttcagactccttagaaagcgctgagcgggaaattcacattttctttaaacaggaagagcttgtaccgtatcaaaaattaatggccgactgggtgtactaagccgtcagcctttctttttctcgcattatgaaaaggtttacatcatttatgaaagacagaggctgcgctgccctgtcttttcgtttctcacaaatcagcccgcgggctgatttttttattgaaatcgtacaatttcgacagaaaacaggctatactaggacaaaagacagcgagattgggagagaagcaatggagccttacgacatttttatcaccaagtggaaacaaataaccggcgttgatttatctttatacaaagaagcacagatgaaaaggcggctgacgtccctttatgaaaagaaggggttcagagattttcaggaatttgccgccgctttggaaaaggacaagcttttattaaacgaaacattggacagaatgacgatcaatgtttctgaattttaccgaaattataaacggtgggaagttcttgaaacctcaattctcccattaataaagcataacaaaccgttaaaaatatggagtgcggcctgttcaacgggagaggagccctatactttggcgatgattctcaatcagcagacgggactggccggatttgatatattggcgacagatattgatgaaaaggcgctaagcaaagccaagcggggcatctatcaggaacgctcgctgcaagaggtgccggcttccgtgaaaagccgttatttcactaagcaggctgacaacagttatcaagtaaaacaagagattcagaaaaacatccggtttaagcggcacaacctgcttgccgacagctatgaacaggattttgatctgatcgtctgccgcaacgtctttatttattttactgaaaaagcaaaagaagagctgtatgtgaaaatggcgggcagtctgaaaaagaacggaattctgtttgtcggcagtacagaacaaattttcagcccggaaaaattcggccttgagagcactgatacatttttttatcaaaaaagatagaagacatttaatgaaaacttgtggtatagttttacttaaaagcgttaatgcgatgaagggagaagaaagaaatgagatacttaacagccggagaatcacacggtccgcagctgacgacaattatagaaggtgtgcctgcggggctttatataactgaagaagacattaattttgagcttgccagacgtcaaaaagggcacggccgcggacgccgcatgcagattgaaacggacagagcgaagatcacaagcggcgtgcggcatgcccggacactcggttcaccgatcgcgctcgttgtagaaaataaagactggacccactggacaaaaattatgggcgccgcaccgattacagaagaagaagaaagtgaaatgaaacgccagatttcaagaccgagaccgggacacgcagatttgaacggtgctattaagtataatcaccgtgatatgagaaatgtgttagaacgatcttccgcgcgtgagacaacggttcgcgtggctgccggagccgtcgctaaaaagattttagctgagcttggcattaaagtcgccggacatgtcctgcaaatcggcagtgtaaaagcagagaaaaccgattacacatccattgaggatctcaaacgggtaacggaagaatcaccggtcagatgctacgatgaagaagcaggccgtcaaatgatggcagccattgatgaagcgaaggcaaacggcgactcgatcggcggaatcgttgaagtgatcgtcgaaggtatgccggtcggtgtcggaagctatgtccactatgaccgtaagctggacagcaagctcgctgctgccgttctgtcgattaacgcgtttaaaggcgtagagttcggcatcggttttgaagcggccggcaaaaacggcagtgaagttcatgatgaaatcgtatgggatgaagagaaaggctatacacgcgccacaaacaggctcggaggattagaaggcggtatgacgacgggaatgccgattgtcgtccgcggcgttatgaaaccgatccctactttgtacaagccgctgaaaagcgtcgacattgaaacgaaagaaccgtttacagcgagcattgaacgttcagacagctgcgcggttccggcagcaagtgtagtggctgaagcagcagtggcctgggaaatcgcaaatgccgtcgtagaacaattcgggcttgaccagatcgaccgaattaaagaaaatgttgaaaacatgaaaaaattatcgagggaattctgatgaaagagcttgaggttcggacagcttcctccgcatatcccgtgtatatcggtgaaggtataaggaaacaggccgctgcccttttgtcttcactgaacaggccgctgacaaagatccttctcatcatcgatgctgaagttgaccggctttacggtgatgagatgttccggcttttaaacgaaacatggcccgtgaaaaaagtgatcgttccaagcggagaagaagcgaaatctctaaaagagtatgaacggattcaaacgaaagcgatcgctttccatatggaccgctcctcatgtatgatcgccttcggaggcggcgtgacgggtgatttggccggcttttgcgcagcaacttttatgcgcggaattgatttcattcaaatgccgacaacactgcttgcccatgacagcgcggtcggcggcaaggtggccgtcaaccataaactcggaaagaacttaatcggtgcgttttatcagccgaaagcggtgatttacgatacggagcttctgaaaaccctgccggaacaagagctgagatcgggcatggctgaagtcatcaaacacgcgtttatcgccgattatgcttttttagaaaaacttctcacgtttgacacgttgcaaggactgacaagcgctgagctgaatgaaatgatttataaaggaatttcaatcaaatcggccgtcgtgcgtgaggacgaaaaggaagaggggataagagcttttctgaatttcggccatacgctcggccatgccgttgaggcggaatacggctacggacggattacacatggagatgcggtcgccctcggcatgcagtttgccctttacgtgagtgaacaggttgcgggttgcaagatgaacaggaaagaactcacacaatggctgattgggctcggctacccgggaagcatcagacaagatattgaaacgccggttctctccgcccggatgatgaatgataaaaaaacgcgcggaggcatgacacagttcatcgtgttaaaggaattaggcgaagcgcgggactgcatgctttcaaaagatgagctcgaaaatttgctgaacaaatggcgaatggaggaaacagcatgatgatacgcggcattcgcggagcaacaacggtggaacaagacaccgaacaagaaattttagaaaaaacacagcagctgcttgaaaaaatcattgaacaaaatggatgcaagccggaagacgttgtacagatcctattatccgccacgcctgatatccattccgtatttccggcaaaagcggtccgccgcctttccgggtggcagtacgtcccggtgacgtgcatgcaggaaatggatgtcaccggcgctctgcaaaagtgtatccgtgtcctgatgacggttcagacggatacgcctcaggatgaaatcaagcatgtctatttagaaaaagccgttgtgttaaggccggatttatcattgacaaaaaatactgacatgtaatacgataaacaaagcttagaaatacacaagagtgtgtatagagctggtaagtaagacattgaacagttgagtttagaatagggtagcagagaatgagtttagctgagctgagataaacacgtttttattctgcccaaaagaagcctttcttttgggtttatttcttatacgcaagactcctctcactcttcatctcattctccttaccgtaaggaggagaatcatgaatttacaatcggatgtttctttatttttaaaggacagtctgacacaccgcaccattccaatcgcagagacttttacggtcgacacgatcacacccattcagatggttgaaaaactggacagaaacattacgtatcttttagaaagcaaggatgagtcgtcaagctggtcgagatactcttttatcggccttgatccttttatcacgattaaagagagtcataacacattcactgccgctgatccaaatgggcatacgctgtttgaagccggagaattaaaagccgtgcttgactggatgaatgagagcttccgcattaaaacacccgagcttgatatcccattttcgggaggggcggtcggttatctgagctatgacatgattcctttgattgagccttccgtgccaagccacgcgaaagtaacagatttcgaaaaatgtatgctgtttgtctgccggaaaatcatcgcgtacgaccacgaaacgaaacaagtgcatttcattcaatatgcggcgcttaacggccgggagacggaggaagaaaagcgggccgtttttaaagaaaattgcgcggagcttcgtaagcttatcggtattttgacagaatcgaaagatatgaaagagccgtttttttctaaagaaacgtttgacacgccaagttttgccgctgtgacatccaattatacgaaagaagagtttatggccggcgtcaataaactgaaagaatatataaaagcgggagacatttttcaaggggtgctttcgcaaaagtttgacattccggtatccaaacattcatttgagctgtacagggtgctccgcatcgtcaatccttcaccttatatgtactatatcaaactgcctgacagagacattgtcgggagttcgcctgaacgtctgatccgcgtgcatgacaggcacctggaaattcatccgattgccggaacgagaagaaggggcgccggaaaagaagaggatgaacgcctgaaaaaagagctgatgaatgacgaaaaagaaaaagctgaacattacatgctcgtcgatcttgcgcgcaatgacatcggcagagttgcggagtacggttccgtagccgttccggaattcacaaaggtcgtttctttttcacatgtgatgcacatcatctctgttgtaaccggccgtttaaaacagggcgtccatcccgttgacgcgctgatgtccgcattcccggcaggaacactcacgggcgctccgaaaatccgcgcgatgcagcttttaaatgaattagaaccgacttccagagaaacctacggcggatgtatcgcttatatcggatttgacgggtcgattgattcgtgtattaccatccgcaccatgagtgtcaaaaacggtacggcgtcggtgcaggcgggcgcgggaatagtcgccgattccgtcccggaagccgaatatgaagaaagctgtaacaaagcgggggcgcttttaaaaacgattcaaatcgcagaagacatcttttctggcggggaggagaagacggatgaacaaatttctgcaatcgtgcgttaatggccgtacgctgaaaactggagaagccgaaaagctgatggagatgatgatgaacggggacatgtcgcagtctgagatcggcgggattttatcggtattagcccaccgaggtgaaacggcggaggagcttgccggatttgtaaaagtgatgcgggcgcgggcacagacatcaggtggcttggcggatgtcgttgatacgtgcggaacaggcggagacgggatttctacgtttaacatatccacggcagcggcgattacagcttctgctgccggagctaaagttgccaagcacggaaatcgctccgtttcgtctaaaagcggcagcgcggatgtgctggaaaaactgggggttcccattcaagccactccagaaagcgttaaacgcagcattgaaatgaaacaaatggggtttttgtttgcgccgctgtttcattcgtcaatgaagcacgtcgccgccgcaagaaaagagcttggcttccgaaccgtatttaatctgctgggcccgctcagcaacccgctgcaggtgaagcggcaggtgatcggcgtctattcatttgataaagcgcgcttgatggcaagcgctctggaacaatttgatgtcagacacgtcatgcttgtgtcggcccgtgacggattagatgaattgtccctctcagcaccgaccgatatcattgaactgaaaaacggtgaacgtctggaatattccgtttcacctgaacaattcggttttacagaaggttcactaaaggatattcaagtgagttcatcggaagaaagcgcgctcctcattcagaatatttttgcaaataaagctccgtcatccgctctgcatattaccgccttaaatgcgggcgcggccatttatacggcaggtcttgcaaacgatctgaaagaaggaacgaaaaccgccttagaagcgattcaaaacggagatgccaaaaggcagctcgaacgtctgaaacagaaagaggaagaaatgtatgcttgatcaaatcattcagcagaaaaaagaagaaatcaaatccatcgtgctgccggaaacctgtcaaattgaacggagatcctttaaaaaagcgctcctggacccgaaccgttttatcgggctgattgccgaagtgaaaaaagcttcgccgtctaaaggattgattaaagagcattttgttccggaaacgattgcggcggattatgaagcggctaaagccgacgccctttcagttctcacggatacccgtttttttcaggggagaaatcaatttctgacagatgttaaacaaaccgtgtctcttcccgtgctgagaaaagattttattattgattcccttcaggtggaggaatcgttcaggatcggcgccgatgccattttgctgatcggggaagcgctggaaccttcagagcttcatgagctttatctggaagccagcgagaagggcatggacgttctcgttgaagtccatgatgaaactgtgcttgaacggattttacaagtgtttcagccggacattctcggcataaacaaccgggacttaaaaacgttccgtacttctgtttcgcaaacggaaaaaatagcgcagcttgtgccggacggctgcctgctggtcagcgaaagcggcatcggttctttggctgacctgcaattcgtcaacaagcacggggcgcaggctgtattggtcggagaatccttaatgagagaggattcgcagcaaaaggcgatccgcggactgttcggggagtgatgatatgaaaaagcctgaggtaaagtactgcgggatacgatcgaagcgtgattacgaacttgcggcagcttcaggagcggattatctgggatttatttttgccgcaagcaaacggagagtaacgccggatgaggtccggaaatggaaagagcaggtccggacagacaagaaacatgccggagtatttgtaaatgaaacgatagaaaacatcgcgcaaatcgcctctgatctggcacttgacgccatccagcttcacggtgatgaatcgcctgaggatgccctccgtctccgtccgcttgtgcgctcggagatatggaaagcgctccatcacggggaagggacgcttcgtcagatggctcaatttgcacctgctgtcgacggatatgtcattgattcttcagtaaaaggaatgagaggcggcacgggaatcgcgttttcatgggctcgtgtccccttgtaccgaaagcaggctcaaaatgcaaacaagcgctgttttatcgcgggcggcgttaatcctgaaacgattaccggcttactgagatcgcgtccgtgcggtatagatcttgccagcggaattgaaaaaaacggacaaaaggatcaaacactgatccggcttttagaagaaaggatgaaccactatgtatccatatccaaatgaaatcggaagatacggcgaattcggcggcaaatttgtccctgaaacattgatgcggccccttgaggaaatcgaaacggctttcaaagaattaaagaatgatcccgtttttcatgccgaatataaaaaactattgtttgattactccggaagaccgaccgcattaacgttcgcagacagggtgtcagagtatttgggaggggcgaaaatctatctgaaaagagaagatttaaaccataccggctctcataaaattaacaacgcgttaggccagattctgcttgccaaaaagatgggcaaaacgaaaatcatcgccgaaaccggtgcgggacagcacggtgtggctgccgcgacagccgccgcaaaattcggttttacgtgtacagtttttatgggtgaagaagacgttgcacgccagtcgctgaacgtattccggatgaaactgctcggcgcggaagtggtgccggtcacaagcggcaacggcacgctgaaagatgcgacgaatgaggcgatcaggtactgggtccagcattgtgaagatcatttctaccttatcggttctgtagtggggccgcacccgtatccgtatatcgttcgcgaatttcagaaaatcatcggcgaggaagcgaaagaacagctccgccgggttgaaggaacgctcccggacaaggttgttgcatgtgtcggcggcggaagcaatgcgatgggcatatttcaggcctttttagacgaagatattgagctgatcggcgccgaggcggcgggaaaaggaattgatacgccgctgcatgcggcaacgatcgcaaaagggacgctcggggtgattcacggttcaatgacctatttaatacaagatgaatacgggcagattatcgaaccgtattccatttcagccggccttgattacccggggatcggccctgagcacgcctatctgcataaaagcggccgtgtaacgtacgaaagcgtgacagacgatgaagcgattgccgcgttgcgtctgctttctgaaacagaaggtattcttccggctattgaatctgcccacgccctggcaaaagcgtttgaaatggcaaaagacatggataaagacaaaatcattctcgtcagtttatcgggaagaggagataaagacgttcatacgctgatgaatgttttggaaaacggggtggagacacatgtttaatctgcgagattctgaaaaattatttatcccttttattacggctggcgatccgcttcctgacatttctgttgagctggcaatatcattgcagaatgcaggcgcttctgcccttgaaatcggcgttccttacacagatccgcttgcggacggacccgtcatacaacgggcttcaaaacgggctctggaaaacggaatgaatatcgtaaaagcaattgaacttggcggcaaaatgaaaaaaaacggcgttcatattccaattatcctctttacgtattataatcctgtgttacaattagaaaaagaatactttttcgctttactgcgggaaaacgacatagacggtctgcttgtacccgaccttccattagaggaaagcgcccttttacaaatgacatgcaaaaaggagaacatcgcttatatctctctggttgcgccgacaagtgaagaccggttgaaaataattactgaacaggcctgcggctttgtgtattgtgtatcctctttaggagtgacgggcgtacgcagcgaattcgacccgtctgtatactctttcatacgtaaggtgaaagaattcagctctgttccggtggctgtcggttttggcatttcaaaccgcaaacaggttgacgggatgaatgaaatatctgacggtgtcgttgtcggcagcgcgcttgtcaaaaaagttgaagagcttaaaacaaagcttgtgaatcccggaacaagagctgatgcgcttcttgaatttgaagaatacgcaaagacgttcggacgactgtacagtgtaaaatgaggtgactggatttgcagattaaagaacagctgcggcagctgaaaccgtatcagccgggcaaaccaatagaagaagtgaaaatggaatacgggcttgagaaagtagtaaaactcgcttctaacgaaaatccgttcggctgttcacaggccgctaaagatgcgctgcatcaggagattgagcagcttgcgctgtatcccgacggttacagtgccgctttgagaacacggctcagtgagcatctgcaggtcagtgaatcttcgatcatttttggcaacggctctgatgagcttgtgcagattatctgccgttctttattaaatgatcaggcaaacacgattaccgccgccccgactttcccgcaatacagacacaatgcggtgattgaaggcgctgaggtgcgcgaggttccgctccgcagtgacggcgctcatgatttggaccggatgctggaagcaattgacggcgagacgaaaatcatatgggtatgcaaccccaataatccgacggggacatatacttctgagcaagagctaattgcctttttaaacagagttcccgagcatatactcgttgtacttgatgaagcgtactacgagtatgttacggcggaagattacccagaaagcattccgcttttaaagcaatatccgaatgttatgatcctccgcaccttctctaaagcgtacggacttgccgcgctgcgcgtcggatacggcattgcggacgaagcactgatccgccagattgaaccggcgagagagccgttcaatacgagcagaatcggtcaggcttcggcactggcagcgcttgatgaccagacatttattcaggaatgcgtcgagaaaaataaagcaggccttaagcagtattatgattttgcagaaactcacggattaacttgttatccttcacaaaccaactttgtgctcattgattttaaccgcccggcggatgaactgttccaagccctgttggaaaaaggatatatcgtccgctcaggacaggcgctcggatttccgacagcgttaaggattacggtcggtacgaaagagcagaatgaggaaattctcacaattttagctgaaatattataagaggtgatcaggcatcacctctttgctctattaaaatagttgaaaaaggaaatgagtgaaatgaaggatactatattgcttgcggggatcgggctgatcggcggatcgatcgcattggccatcaaaaaggagcatccgcataaacggattatcggtgtggatatttcggaagaacagctcactgccgcgctgaagctcggaattattgacgagcgggccggctcatttacggaaggggcgcagcaagcgtctgttgtcattatcgccacgcctgtcgcccaaacgctgaaaatgctcgatgtgctggccgcatcagacatcacccatgaactcctgattacggatgtgggcagcacgaaacagaaagtcgtcagctacgccgacaaagtgcttccggctcactatcaatttgtcggcggccatccgatggcgggatctcataaatccggggccgctgccgcgaaagaatttttattcgaaaatgcgttttatattttaacacccggaaaatcaacttctaaagagtcagtaacgcatctgaaggaactcttgaaagcggcaaacgcccactttgtggagatgacccccgaggagcatgacggcgtaacgagcgtcatcagccatttccctcatatcgttgctgcaagcctcgtacatcaggctcatcatgctgaagaagattatccgtttttgaaacgtttcgcagccggcggttttcgggacatcaccaggatcgcctcaagcagcccggcgatgtggagggacatacttcttcataacaaagataaactgcttgaccgcttcaaagaatggaaacgggagattgacacgatcgaatcttatgtagaaaatgaagatgcggacagcctgttcggatattttaaaaaagcgaaagattatcgcgacggtctgccgctccgtcaaaaaggagcgatcccgtccttttatgacctttatgtcgatgttcccgatcatccgggggtcatttcggaaattacggcgatattggcagaagaaaaaatcagtatcaccaacatccgcattatcgaaacaagagaagatattaacggaattctcagaatcagtttccagactgatgatgaccggaagcgtgcggaaacctgcattcaatcccgcgccaaatatgacacattttacgctgactgaggtggaaaacattgaaaagagaaaaagtgacgtctttaaacggtgaaattcatattccgggggataaatccatctcccaccgttctgttatgttcggagcgcttgcggaaggaaccacaacggtaaaaaactttttgcccggagccgattgtctgagcaccattgcctgcttcagaaaaatgggtgtctccattgaacaaaacggaagtgatgtaacgatatacgggaagggcattgacgcactttgtgagcctgacagccttcttgatgtcggaaattccggcacgactatccgcctgatgctcggcattttagccggacgcccatttcacagtacggtagcgggcgacgaaagtattgcaaagcgcccgatgaagagggtgacggagcctttaaaacagatgggagccgcgattgacggaagagcggacggaggatttacgcctttatccgtaagaggcggacaattgaaaggcattgattacgtctcccctgttgcaagcgcgcagatcaaatccgccgtgctgcttgccggattgcaggctgaagggacgacgaccgtcactgagcctcataaatcaagagaccatacggaacggatgctgaacgcttttggcgccgagcttgcggaaacggagacgagcgcttccgtaacgggcggtcagaagcttcagggggctgatattttcgtgcccggcgatatttcttcagcggcctttttcctcgcggcaggcgctgtcgttcccggaagccggattgtgctgaaaaacgtcggcctgaacccgacacgcacgggaatgattgatgtcttaaagcaaatgggagcttcacttgaagtgattccttcagaagcggacagcgcagagccttacggagacctggttattgaaacctcagctctgaaagcggcagaaatcggcggagaaatcattccccgtttaattgacgagatcccgattatcgcccttttggcaacgcaggctgaaggcacaactgtcattaaagacgctgcggagctgaaggtgaaggaaacgaaccggatcgacaccgtcgtatcagagctccggaaaatcggcgcagacattgaaccgactgaagacggcatgaaaatacacggcaaaaaaacgcttgcgggcggagccgatgtgtcaagccacggtgaccaccgcatcggcatgatgctcggtgtcgcttcatgcctgacagaagagccgattgacatctgtgatactgaggcaatccatgtctcatatccgacattttttgagcatttagatcaattagccaaaaaagcctgaagacgattcttcgggcttttttcttcatgtgtcataaaactttgggctttgacatagcttgtcttaaacagaaaataacagaaagggggaatgcgttttcgttacagagacagccggaacaaattgcgctgtttgcgtataaagatgccgtccccttttttgccgttttcctcttaatcattttctgataaactataatgccgggtaaagcatcttatttgcgggcaggccctgtctgaattatgataagaataacccgaataaaaacccttttcattggttgatgaggtataggaaaagaaaggaccggtctgatttgaatacattgatccaagaagccataaaattagttgaagcaggtgaaaccgaaaagggactcaaagcgctttcaaaagctgaaacgcagcttcatgacgaagacaaagccattgcagcccagctctactatgaatggggaaacgccgaaaaagcgttagcgctgatcagtgatctgcatgacctttatccggatgagtctgagctgacgaatttttacgccgaattgttaatagatattgatgaagaagaaaaagctcttgaggtgctggagacaatttctccggaagacccgtcttacgcggaaagccttcttttaatggctgatctgtatcagatgcagggcttatttgaagtaagtgagcaaaagctgttacaggcgaaagcgatgttacaagatgaacctgttattgatttcgctctgggggaattatactttactcagggatcatacgcaaaagccgttccttactatgaagagacggcaaaagaacggcacgaaatcggcggcgtaaatgttcatcagaggctggctgagtcattgagcgcggcgggtgaatttgaggaagcgatttcatggtatgaaaaagcggcggcagaacatacagaaccgaatacgattttcgggtacgggttcacagcctatcaggcgggaatggtcaaaacagccatcaagcagctgtctgatttaaaagggcttgatccttcctattcatcgctttatatgccgcttgcaaaaagctacgaggcagaaggcatgtatgaagatgcattaaaaaccgctaaagaaggtattacttacgatgaatacaataaagagctttttctctatgcggcgaaaatggcgttaaagctcggcaacgcagaagaaggcaaaaagcttcttcaggaagcgctggcgctcgatccgggttacgtggaagcgctccatacgcttttagccgtctatcataaagaagaaagctttgaagagattattgatctgattcaggaagtccgcggctacggagaagaagatccgaaatacaattggtatttggcgggtgcttatacaggccttgagcaatacgctgaagcgaaaaaaagcttcgaagctgcgtatctccattatcaggatgatcgggatttcttatatgaatacgctcacttcttattggaagagggtctccagaaagaagcgctgccgcttttaaaacaagtgctttcaatggatggaacaaacgaagagcttgaagaaacaatcttacggatagaggatgaatttttaagataagcaggattttgaaccatgcttgctgaatgtataagtgatgtcagattatacgatcgatagaggagggaattacatgcagacccctgtttctgtcaatgaaaaaaaggattttatccgttggtttttaaatcattatcagcttaaacgccgggagtgcgtctggattttaaattatttaatgagtcatgattcattaatggaaaaagtccattttgtagaacaagctgaattttgcccgcgaggcattatcatgtctactcattgcgttgatgaggtgccgtttaggttttacaaagaaaatgtcatgactacggacgcggaaaaatcttttcacgacatccggttaaataaacagcaggatttatttatccagctgaatttccgttcggcctacagctcaccggaatatgccgctgttcttgaatcaaatccgcatctgccgaaagacctgtttgaaaataaacaggatcaggggatggccgaaaaaatattagaacacgccatttccactttccagcgggaaaagctgcttaaagatatcgacgaggcgctggatcgccacgacaaagaaacatttgaaaagctttcccgccaattgaatcagctcacataaatgacagccttgcagaatatgcaaggcttgttgcgtaaagaggaggaacgagacatgagatggagggccgctgatgccgatgcctatttacaatctgcggattacattgataccgctgtcattccgttaatttccataacatcttcaggaggcttaaaagaggccgttgaacagggggaaagcacccaattgctttctgaagagcttgagcgccaattgaagggacgggtatatttattcccctcttatacatatgttgatatagaccaatcacaaatcgctctgcttcaaaaactcaaagaagaggtgatgaccaactttcggcacgccttgttcctgacggcagacgaaaaatggaaggattctgaaatagggtctgatgtcatatacatacctgccgttccgtttgaacatatgaaagactctttaaagagaaaaatagcggatgacaagtgcggagaaattttgaacgttttgttacagaagtggaacaattcttaaaaacaccaggcatcccgcaaaacacccgttttgcctctgttgaccttgctgaaagattcatatattatgagggtgtcaaatctcagaattattttctattttagttaatttttggtcaatctttagggggggaagagatgggcggaaaacaagatatatcaagaagacaatttttaaactatgcgctcaccggcgtggggggatttatggccgccagtgcgcttatgcccatggtccgttttgcgctggacccggtattaaaaccgacgggagatcaaaaaatggtgcaggttgtcagtgtggatgagctgacgaaggagccgaagcggtttgactttaaaattcatcaagtcgacgcctggtacgaatcggaagaatccaggtcagcctgggtttacaagcatggggatgaaattatagcgctttctccgatctgtaaacatttgggctgcaccgtaaactggaacaatgatcctaaaaatccgaacaagttcttttgtccctgccattacgggctgtatgaaaaagacggcacgaacgttccgggcacgccgccgctcgcgcctcttgaccgttatgagcaaaaagtaaaggatggctttttgtatcttggaaaagcaaagcctaggggggaagggtgacatgctgaacaaaatttatgactgggtggatgaacgtctcgatattacgccgatgtggcgggatatcgccgaccatgaagtgccggaacatgtaaatcccgctcaccatttctcggcttttgtctattgtttcggcggtttgacgttttttgtaaccgttatccaagtgttgtccgggatgtttttaacgatgtattatgtgccggatataaaaaacgcgtgggaatctgtgtattatttgcagaatgaagtcgctttcgggcagattgtaaggggtatgcaccattggggtgcaagtttagtcattgtgatgatgtttttacatacgctgcgggttttctttcagggagcttataaaaagcctcgggaattgaactggatcgtcggtgttctgatcttttttgtgatgctcggtctcggttttacagggtatctgctcccatgggatatgaaggcgctgtttgcgacaaaggtaggtcttcagattgcggaggcgacgccattgatcggagcgcaggtgaaaactcttcttgccggccaccacgatattgtcggcgcccaaacgctgacgagattttttgcgattcacgtattttttctccctgccgctttgtttgcgctcatgggcgcccactttgtcatgatccgcaagcagggaatttcaggaccgctttaatacaaatctgatataaaagggaggggatgacatgcaccgggggaaaggaatgaagtttgtaggagattcaaggataccggctgaaaaaaaaccgaatataccgaaagactattcagagtatcctggaaagacagaggcgttttggccgaacttcctgctgaaagaatggatggtcggggccgttttcctcgtcggatttctcgttttaacgattgtgcacgagccgcctttggaacgggtggcggacccgacggatacagggtatattccgctgccggattggtattttctatttttataccagctattaaaatatgaatatgccgcagggagctacaccgttatcggcgcgatgattataccgggtcttgccttcgggtcgctgcttttggctccgtttctcgacagggggtctgaaagaaggccgtggaagcgtccggttgcggtcggcatgatgcttttggcgctttgcgctacggtctttttaacgtggcagtcagtcgcgacgcatgactgggcgaaggcggaggagcaagggaaaatcaaaaaagaagccgccattgatactgaatcagacggttataaggtatttaaagaacaaggctgtatttcctgtcacggggataatcttcaaggcggaagcgccggtccgtccctggtcgataacgggctgagcccggaagaaattaaaaaaatcgccgttaaagggaaagggcagatgccagccggtatttttaaagggaatgacaaacagcttgatcagctggcgaagttcatttctgaaacgacagcgaaataacgtattgtgaagtagacaatagcaggatatacttttatgaaaagagctgaccggatgtcagctttttttgcatgatacatactttttacggactgagagttgatggtatgaggtggatttcttatcttttagggttgcgcggcatgcttctgcttgttcttgccgttaattttatcggtacggtgtacggctattattggtatgtgcctcagcttgcggacacgccgttccgatttctgatatttgtgcctgacagcccgacggcgacgtttttcttcctgttcgtgcttctggcatttctcatgggaagaaacgcgccgctgtttgaagcgctggctcttgtaacccttgtaaaatacgggctgtgggcggtcggaatgaatgtctttgtgctggtcaaaatggggcagatgcctttggaagggtacatgctgattgcttcacattttgccatggccgttcaaggcgttttatacagcccgtattttcggttccggttatggcatcttgccgttgccgctgtttggacgcttcataatgatgtcattgattatcttttcggcatgatgccccgctactcaatgctcaatgactatatgcaagagatcggctatgctacattctggctgagcatattttcactcggccttgcatactatttggtgatttctaaaagacggataaagcttgacttacactgatagaatcttggtctaaccttgtcccgctcctcatattctgtaaagagaaggagtgggagggacctctatgaaacgaaagctgacgatctgtcttttacttgctcttatgtgtttcatcacaactgccaaagctgaagatgagggcggtctcaaggaactgaacgacctttcggataccgttttccaaatgacgcggcgttcgcagtatgatgaggctctgcaagtgcttggctactttaagaaaaaaatgacacacgtaaactcactgagcggcgccgaagtcaggcaggtgactctgggtttcaatgatttagtgcgcgttctgaaacaggcagacgcctcagataccgaaaaaatccgggcagccgcccagttcaggttggtaatggatgcgatggaagaccactccgatccgctgtggggttcgcttgaaagaccgattatggcgacattcagcgccttaaaagaagatgtcagcggaaacggaagtgaaaatttcaatgaaaagtggaatgaatttatatcattatatgatttaatttatcccagcctgacaatggatgtgtcggccggccagcttgatacggtggcgaaacatatcgaggtgattgagcaggacgggtttcagcagatgacaaaaggaacaaagcttgagcgtctgacgctcctgcaacaggatttaaagcgggtttttgacaaggtggagcgggatgacgctgacccttcgctgctctgggtcattctgacaacaggcggtatcattattactgcgctgacatatgtcggctaccgaaaatacagagcggaaaaaaagaaagagaaaaagcgtgagtatcctaagtctaaataaacacaaattgctgtaaaggagctaagttagtgaaaaaactcatccagcaattggcttcaaaacacctcccgcagccgatcagaggcagaaaaggggcgactgacgaaggaccgcgaaacctcgcgcgtgacttccagaatcctgacatgctcgttccgccttcaacggatgcaggaacggttcaaaacttgaaattctcattttctgatacgcatatgaggcttgaagacggcggatggtccagagaggtgacggtcagggaactgccggtatccaaaaacatcgcggcggtgaacatgagactgaagccgggagctgtgcgggagcttcattggcataaagaagccgaatggggatatgtgattaacggaggagtccgtttaactgcggtcgatcaaaatggaaggaattttattgacaacgtaagtgaaggggatctgtggtattttccttccggcattcctcattccattcaaggattagagcagggcagtgagtttttgctcgtctttgatgacggctctttttcagaaaacagcaccttttcagtaacggactggtttgcccataccccgcgcagcgtgctggaggcgaacttcggtgttcccggatatgacttggcctacattcacaagaaagagcgttacatgttccagctggaaccgcctcccccgattgaaaaggcagcagtttcttccccggaaggctccgttttggagccgttcagctacaagctttcccggcaggagccccttgttaccagcgggggaagagtaaagattgtcgattcaaaaacgtttaaggtgtcaaaaacgattgccgcagctctcgtggaagtcgaacccggaggcatgagagaattgcattggcatccgaatacggacgagtggcagtactatctttcaggagaagcgaaaatgacggtgtttgcggcggagggaagagcgcggacatttaactatcaagcaggtgacgtaggatatgttccttttgcaatgggacattatgttcagaataccggtgacaccgtgcttcgctttctggaaattttcaaaagcaaccgtttcgaagacgtctccttaaaccaatggctggcactgacgccgcagcgcttcgtcgaacagacgctcaatgtcagtccggcattcgcccgccgattgaaaaagaaaaaatcaccggttgtcaaatggaaacacaaacagtaaaggcggcaaaagccgcctttttattatcgtctgatcggatttttattttcatcaagcgtaaatccttcgccgagcacatcatgaacgtcgcttactgcaacaaaggcgtgcgggtcaacggaagtgatgacgcttttcaaaagcacaatttcgtttttcggaacgacgcagtaaagaacgtccctgtcttcttttgtataggatccctgtccttttaaaacggtgacgccgcgctccatctcttcaatgattttttgctggatcaaatcgtttttcgaagaaataatcgttgccccttttgcggcatagccgccttcctggataaaatcaatcaatctcgcagcgacaaaaacggctacaagcgtgtacatcgcttccttgtaagaaagatacgtaaacaaagaaagcagaatgacacaggcgtcaaaggcaaacatcgtccggcccatcgggattccgaaaaacttgttgatcagcctggcgatgatatcgaccccgcccgtcgtgccgccgtatttaaaaataatgccgagacccgcgccgataaatacaccggcgaacaaggcggccagcgctaaatcatgcgacagcggcatatgaatttcgtaacgctgaaaaacactcagaaaaacagaaagagagacggtgccgatcagggtatagacaaacatcgttcggccgagcatacgccagccgatgaaaaagataggaatgttcaataccaggttggaaatagaagggctgatgtggaataacgcatataaaagcagcgtaatgccggtaaatccgccttccgccaaattgttctgcatattaaagtgaaccagtccgaatgaaaaaacagcagcgccgattaaaataaagcaaatgtttttgattctgatttctccaagcattgcatcaaaccccttttccttccataagattgcgtaaatattatagtggatacaaaagaaaacagcaaactgccgtttttaacatttgtcaaatgtacttgaattagctaacatggaagagatgacaggaggtattcgcacagtgagtgacaaaacgatgaaagacttacaagctgaggtcgatgaatatatcggccaattcaaagaaggctatttcagcccgcttgccatgatggcccgtctcacggaagaactgggcgaacttgcaagagaagtcaaccattattatggggaaaagccgaagaaaacgacggaaaatgagaaaagcatggaagaggaaatgggcgatgtgctgttcgtcctgatctgcctcgccaactcccttgatatttcattggaggaagctcataaccgcgtcatgcataaatttaatacacgtgataaagaccgctggactagaaaagaagaaggaaagtaggagaaaccatgtcaaatgaaaccattaaagtcgtcattgccggaccaagaggcagaatgggccaggaggccgtaaaacttgccgtccgcacgcctcattttgagcttgtcggcgccattgaccatacatacgatcagcaaacattgcgggaagtgatgtcagctgattcagacgctcttatttatacggatatccgcgcatgtttccaagaaacaaaaccggatgtgctgatcgatttgacaacgcctgaaatcggcaaaaaacatacgaaagccgctcttgaacacggcgtccgccccgttgtgggaacgaccggattttctgaagcggatttagaggagcttcaagccttgactgaagaaaaaggaatcggcgccatcatcgctccgaactttgcattgggcgcggtgctgatgatgaagttctcacaaatggccgccaactattttgaagatgtagaaatcattgagcttcatcatgatcaaaagctggatgccccgagcggaacggcgctgaaaacagcggaaatgatctcaagcgtccgtacagaaaagcagcagggccatcctgatgaaaaagaaattctgccaggcgcccgcggtgctgaattaaacggcatccgccttcacagcgtgcgtctgccgggccttatcgcccaccaggaagtcatgttcggcatggacggccagacgctgaaactgcgccatgactcctataaccgggcttcctttatgtcaggagtgaagctgtcagtggagcaagtgatgaaaatcgaccagcttgtatacggactcgaaaatattatcgactgaatcggcaagggggagaacatcaaatgaaaatcgctttgattgctcacgataagaaaaagcaggatatggttcagtttacgaccgcatataaagatatactgagccatcatgagttatacgcgacaggtacgacaggcctgaaaatccaggaagcgaccggattgtccgttgaacgttttcaatccggcccgctcggcggagatcagcaaatcggcgcattgattgcggcaaatgccctggatctcgtcatttttctgcgcgatccgttaactgcgcagcctcatgaaccggatgtctcggcgctgatccggctgtgtgacgtatacgcgatcccgctcgccacaaatatggggacagcggaaatcctcgtccggacgctggacggcggggcatttgatttccgcaatcttgtgcgcggaggagagccgaatgtctgaacacgttgatattctggcgttcggcgcccatagtgatgatgtcgagatcggtatgggcggcacgatcgcaaaatttacggctcaaggaaaaaccgcggtgatatgcgatttgaccgaggccgaactatcatccaacggaacggtagggataagaaaagaagaagcggcagaggcggcacgaattctcggcgtaaaagagagaatccagcttacgtttcccgaccgcgggcttttgaaaagtgaggacggcatccgccggattgtcagtgtcatcagagcctgccggccgaaaaccgttttcatcccttatccgaaagaccgccatcctgaccacggcaatgcggcggctttggtcgaagaagcggtgttctcggcgggaattcataaatacagagatcaccaggaactgccggctcataaggctcagcgcgtatactattatatgatcaatgggtttcaccgtccggactttgtaatcgacataacggaaaccatcgatctgaaaaaagaaagcctgcacgcctatcaaagccagtttattcctacggcgcagtcagtgaacacaccgctgaccaacggttatattgaaatggtggaagcgcgggaaagactgtatggcaaagaagccgggacggggtatgccgagggtttcttttcaaaacagcttcccgttttgaatgatgatgtttttgggggcggacaatgagaccattaaaaatagggattacatgctacccgagtgtcggaggctcgggtattattgcgacggaactcggcaagctgcttgcagaaaaagggcaccaggttcatttcatcacatcaagcatcccgttcagattaaatacatatcatccgaatattcattttcatgaggtggaagtcaaccaatacgcggtatttaaatatccgccttatgaccttacgctggcgagcaaaatcgccgaggttgccgcgagggaaaatcttgatatcattcacgcgcattatgcgctgccgcatgcggtatgcgcttatcttgccaaacagatgctcaagcgcgacatcggcatcgtgacgacgcttcacggtacggacatcaccgttttaggatatgatccgtcattaaaagatttaatccgttttgccatcgaagcgtccgacagagtgacggcggtatcaaccgcgcttgccggagaaacatatgacttaatcaagccggataaaaaaattgaaaccatctacaactttattgatgaacgtgtttatcttaagaaaaatacagagagtataaaagagaaacatggcattttgccggatgaaaaagtcgtcatccatgtctcgaacttcagaaaggtaaaacgtgttaaagatgtcatccgcgttttccgtaatatcgcagccaaaacaaaggcgaagctcctgcttgtcggcgacgggccggaaaagtgcgtcgcttggcagcttgtcgaaaaatacggtttgcaggatcaagtgctgctcctcggaaaccaggacagggtggaagagctgtattccatcagtgaccttaagctccttctttctgaaaaagaaagtttcggactcgtacttctggaggcgatggcctgcggcgtgccgtgcatcggaacaaatatcggcggaataccggaagtgattaaagatcaagtaagcggttttctggtggaagtcggcgatattcaggcggcatctgaaaaagcgcttgccgttttagaagataaacagctcagcaaacgattgactgatcatgcgctgaaaatggtggagaccgccttttcttcgcaaagaatcgtcagtcagtatgaacggatttatgacgaattggcaggaccggagtgatcttatggaacaggaatttgtcaaagccctccccatccttcatcatctgatgaaggcgggccatcaggcgtactttgtcgggggagccgtcagagacagctatatgaaacgaaaaataggtgatgtggacatcgcaaccagcgcttcgccgaatgaggtggagcgtctctttaagcggactgtcgatgtaggaaaagagcacggcaccgtcatcgtcctgtgggaagatgaaacctatgaagtcaccacttttcgtgccgaatcagaatataaggactaccggcgccctgaagctgtgcggttcattacttctttatcagaagacttaaagcggagagacttaacgattaatgcgatggcgatgtctgccgaaggagagctgcttgattatttcggaggcgcacatgatatcggacaaaagctgatccgtacggtgggtaatcctgaagaccgttttcgggaagacgctctgcggatgatgagagcggtccgctttatgagtcagctcggctttctgttagaaaaagaaacaagagaggccgtcataaaagacagggagcttttggcacatgtatcagtagaacgaaagaccgtcgagtttgaaaagctgctgcagggcgcttcctcacaagaagcgattcaaacgatggtgcagataggtttgatacaagagctgccaggcctttccggttatgagcagcaaatgcttgaagcaagcggctttcctttttcttctttagatgcacgcgaagaacgctgggcagcgctgttattgtttctcggtctttgtccgaaaagcgccgaggcgtttttaaaacaatggaaactgccgggaaaagtcataaaaaaagcggtgcagatcataagcgtttatccggcgcagctggaagcggaagcgatgtaccgggcgggagaggcgctgttttcagccgttaaaatcgggatgctgaaaaagcataagacgattgatgaacaaaagctgaaaaaggttcagagcctgtatgagcagctgccgatcaaaagccttcgagacctcgacatttcaggcgctgatctgatggagctcagaaaccgccgcgcgggtaaatgggtggccgaagaacttcgccggatcgaagaagcggtattggcagggaagctccctaaccgaaaacatgatataaaggagtggctcgcatcatgggatcaacattaagaacccgattaattgatttattttctgaggcgggtgacggctttatctccgggcagaaaattagtgacgcgctcggctgctcgagaaccgccgtttggaaacatatagaggagctccgcaaagagggctatgaagttgaggcggtcagacgaaaagggtacaggctcattaaaaaaccggggaaactcagtgaatccgaaatccgtttcgggctgaaaacagaggttttgggcaaacagcttcattaccgggacgtcctgccgtccacccaaaaaaccgctcatgaacttgccaatgacggcgcgccggaagggacgcttgtagtcgccgataaacaaacggcaggcagaggaagaatggccagagtatggcattcacaggagggaaacgggatttggatgagcctcattctgagacccgacgttcctttgcaaaaaacgccgcagctcaccctgttatccgccgttgcggtcgtacaggccatcgaggcttttacaggtgtacagcccgccattaaatggccgaatgatttaatgattcacggcaaaaaagccgtcgggattttaactgagctgcaggcagaagaagaccgtgtccgttcggttattctcgggatcgggatcaacgtgaaccagcaggaaaccgattttcccggcgagcttcaggacattgcgacaagcctcagcatggaagccggcgaaaaaattgacagagcgggtctgatacaagagattctgctgacttttgaaaaacgctatcaggattacttgaaccacggctttacaccgatcaagctgctatgggaaagctatgcggtcggactggggaacgagctcagagcgagaacgctgcaagggacgttttacgggaaatcgctcggcattgatgatgagggagttcttctcttggaaacgagagacggtataaagaagatctattctgccgatattgagctcaattaatcttagttggtacaagcctcgtgaatttggtatacttcctatgggcagtatcataatgaactgcacctgatcagcagaacagagattacgaaaagtctgccttgatccaaaaaaggactgggacagagggatgacattcgccgaaggttaaacaagtggggatccttcttattttacagaaggcttttttgcttgcgaagaattggcggctcatctcctcaccgtttagaggaggagaaacagaatgaaaacaaaactggatttcgtgaaaatgaaggaaaacggagagccgatcgtgatgctgaccgcttacgattatccgcaggcaaagcttgcggaacaggcgggagtcgacatgattttagtcggggattcgctcggaatggtcgtgctcggactcgattcaacagtcggtgtaacggtcagtgacatgattcaccatacaaaagcggtaaaacgcggtgcgaaaaatacgtttatcgtaactgacatgccgtttatgtcttaccacctttcaaaagaggatacattgaaaaacgccgcggccattattcaggaaagcggcgcggacgcgttaaagctggaaggcggagacggcgttttcgaatccatccgcgcgctgactctcggcggaattcccgtcgttagccatttaggcctcacaccgcagtctgtcggcgtattaggcggatataaagtgcagggaaaagatgagcaaagcgcgaaaaagctcattgaagacagcatcaaatgcgagcaggcgggagcgatgatgctcgtgcttgaatgtgtgcctgctgaactgactgctaaaataaaagaagaagtatccattcccgtcatcggaatcggagccggttcaaaagcggacggccaagtccttgtctatcatgacgtcgtcggccacggcgtggacagaacaccgaagttcgtgaagcaatacgccaaaatcgacggcacgattgagtcggccctcagcgattatgtccgtgatgtgaaagaacgggttttcccggaagaaaagcattcctttcagataaaccaaactgtgctgcaaggcttgtacggaggaaagtaagcgatgaaacaactgacagaaactcaacagctgaaagaattgattgcacaataccgctcagaaggccggacgatcggattcgtcccgacaatgggttttcttcatgaaggacatctgacgctggttgaaaaagcaagcaaagaaaacgatattgtggtgatgagcatctttgtcaatccgactcaattcggaccgggcgaggattacgaagcatatccgcgagatttaaagcgcgatgcccggcttgcagaacaggcgggggcagatgttttgtttacgccgtctccaagtgacatgtacaaaggcgagcaaaatgttgccgtgcaagtgaaaaggagaactgacgtgttgtgcggcgcctcccgcgtcggccattttgacggagtggccactgtgctgacgaagtttttcaatctcgttaaaccgacccgcgcctacttcggcctgaaagatgcccagcaggcagcggttgtggacggattaattgaggacttctttatggatatcgaattggttgcagtggacacggtcagagaagaagacggacttgccaaaagctctcgcaacgtctatctgactgagcaggaacgcaaagaagcgccgatgatctataaagcattacagcaaggcgccgaactgatcagagacggtgaaagaaatccggaaaccgttataaaaaccgtcaccgatatcatcgaaaacacaagcggcgtcattgattatgccgaactgtacgcttatccggagctgactccgcttaaaacattaaacggcaaggtcattctggcctgcgccgtccaattttctaaagccagactgattgataatatcattattgatattgatgaatgggagagatcataatatgtaccgcactatgatggccggaaaactgcaccgcgctaccgtgacggaagccaatttaaactatgtcggcagcattacgattgatgaagatcttttagatgccgtcggaatgctcgctaatgaaaaagttcagattgtgaataataataacggagcgagacttgaaacgtatattattcccggtaagcgggggagcggcgtcatctgtttaaacggagcagctgcccgtctcgtccaagaaggagataaagtcattattatttcttatcaaatgatgtctgatcaggaagcaaaaagccatcagccgaaggtggccgttctggatgatcagaataaaatcgagcagatgctgggtcaggagccggcacacacgattttgtaaaagagcccccttcatgggggttttcttttaagatttaggggcaaaagctgtttttccgctccatttctcaacaaaacgtgttacacttttctcgtatgcaagaattgaggtgtccattttaatgaacaaacaacggttcgttgtcatagatgtcgaaacaacaggaaattcgccgaaaaagggcgataaaatcattcaaatcgcagcggttgtcattgaaaatggacaaataactgagcggttttcaaaatatatcaatccgaatcaggccatcccgccgtttattgaacagctgaccggaatttcgtccggaatggttgaaaatgaactgccgtttgaagcggtcgcagaggagatttttcatctgcttgacggcgcgtattttgttgcccacaatattcatttcgacctcggatttgtccggtatgaactgagcgaagcgggctatgagctgccggattgtgaagtgcttgatacggttgagctttcgcgtattgttttcccggggtttgaaggatataagctcggtgagttgtgtgcggagctgaatattgttcatgaccgccctcaccgcgcagacagcgatgcggaggttacgggactggtctttttagacattttacataaactgaaacatttgcctttaccgacattaaagcagcttagaaggctttcacagcattttatcagcgatttgacgctgcttttggattcttttatacatgaaagcaggccggcggaagaaaagcgctgcattccatacgcctctttttcaattaaagagcccgatcacattccggtttcccgtccggtgaatgcggccattgaccttgaaaagtggaacgaagaaaaagaacagatcttatccggcatcatcccccgctatgaaaagcggaaagggcagctttcgatgatggatgaagtgcttggcgccttccgcaatcgggagcatgcgctgattgaagcggcgcccggcatcggaaaaacgatcggttatctcgttccggctgttttatttgccaaagcggagcaaactcccgtgattatcagcacgtactctactcttttgcagcagcagatcatgtctaaagatcttccgcttttggagcgtatgtttccttggccggtcaaagccgctattttaaaagggaaatcacattatctgtgcctgcctaagtttgaacatattctgcatgaggaagatgacaactatgatgcggttttgacgaaagcgcagcttctcgtctggctgacggagactgaaacgggcgacgccgctgagctgaatcttccatcaggcggcagattgctgtgggagcgcatggcttacgatgagaattcttttttgaaaaaagggaaggactcggctgccgggttttatgaacgggctaaagaaaaggcgcaggccgcagatctgattatcacaaaccatgctttgctgttttcagatcaaagcagtgaaacgaaaaaactgcctgcaagcggaacggtcatcattgatgaagcgcatcatttcgaacgcgctgccagcgagcacctggggaagagagcttcatacatcggactgcacacaaagctcagccgaatcggaaccttaaaggaacacggactgttaaagcggatgagaaaactgttttatacgtatgaactgccggcggaaagtttttttgacgccgatgagtggatgaagcatattcaatcggaaagcgacgcatttttcagttcagtgcattcttttgtcaaacgaagaaaacctaaagacgatctgaaccgtctcgtttatagtctcaatcataaaagccaggataaagggtttcacatgataacggacggagccgagcggctttgtgcgatgctggatcagctgcttgacatgttttcagtacaggagaaactgttacatcaaaagcttgatcagatgaaaagcggagcggcttttttagcggccgaatatgtaaagtgtatcagggggctgaaagaatatcgcgatacgttcagcaggctgctgtttgaaaatgatgagaaagaagccgtttgggttgaaattgacgcgaagggcgcaaaaaatgccgtcagtatctatgcgcagcctttggagcccggtgaaatgctggcagaccagtttttcgcccgcaaaaaaagcgttgtgctcacatcagcgaccttaatggtggagcattcttttcaatttatgattgaaaggctcggacttgcggatttttatccgcgcaccaaaagcatcccgtctcctttttcatacgatgatcagatgaacgtcatcattccgaaagagatgaaatccgttaaatatgacggagagcgggaagtcattgagcatattgccaagtatgcagaaatcatgtcaaagggaaaacagccgaagatccttgtcctgtttacgtctcatgatatgctgaaaaaagtgtatcaggaactgaaactcagtatggagatatcaggcattcagcttctcgcccaaggtatttcgggcgggagtcccggtaaattaatgaaaacctttaaaacggcaagccgggcgattttgctcgggacaaatcatttctgggaaggcgttgattttccgggggatgaattgtcaaccgtcatgatcgcaagacttcctttcagggcgcctgacaatccgcttcatgccgcaaaatgcgaatttgccaaaaagcaggggaaaaatccgtttcagacgatttccctgcctgaggccgtgttaacgttcagacaggggatcgggcgcctgctccgtacggcgggagacaagggaacaatcgttcttttagatcagcgtgtaaagacggcgggatacggacggctgtttcttgaagcgctcccgacttcatctcttttggagctgacggatgccgaactcggggattatgtcagccaaacggaataaaagccgcataaacgcggctttcgtggtgtgggatgaggaattgtttttatagtaaaagcgggttcatgccgccttgtgattttattatgccgcgggcgcatcccgttatgactaacaaaatttgttcgaccgatggagggtataaaaatggaaagcaaaattgaaattctgtcaacgattaatgtggagcattcagatgatttatataaaatcgtcgatacattaaaccggactttgaaacgggacaatctgatgttcgggcttgcgctcgacgaagaaaatcaaaatgaagcggtcttcaccatttatcgcacataggtgaaaaagatgagaaaaaaagcattaatatttacagccgtatttggtattatttttttagcagttcttttattttcggccagcatttttaaatctgcaatggcccaaaaagaagaaggccacgaaacagctgccgcagccgctaaagaaaaaacggatctgacagatgctgagaaagtggagacctttgtcggcaaacagaaatattatgttgttaccggaacggataaacatggaaaagatatgtatgtatgggttccggccgacaaaaaagcaaaaattctctcaaaaaaagccagtgacggcatttcaagcggcaaggctgccaagatcgttcgggacgaagggcttgtttccaagctgaatggcgttcacccggcgagagaaaacaatgttccgttatgggaagtgacctatatcaacaaaagcgggcagtatagctttagttatgtggactttacaagcggcaagattctcaaaaacatcacaccgtgagacgtattagggggagttcaagttgaaattggcaaaaagagtatccgcattaacaccgtctgcaacacttgcaattactgcaaaagcgaaagagctgaaagcagaaggccatgatgtcatcggcctcggagcaggagaaccggattttaatacgcctcagcacattatagatgccgcggtgcgttccatgaatgaaggccatacgaaatatacgccttcaggcggtctgccggcgctgaaagacagtatcgcaaaaaaattcaaaaacgaccaggggattgaatataagccgtcagaaatcattgtctgcaccggagcgaaacacgctctgtatacattatttcaggttattctcgatgaaggggacgaagtgattataccgactccttactgggtcagctaccctgagcaggtgaaactggcaggggggcgtcccgtctatgcagaagggctggaatccaatcagtttaaaatttcaccggagcagctgaagcaggctatcaccgagaaaacaaaagcgctcattatcaattcaccgagcaacccgacaggtgttatgtatacgaaagaagagcttgcggaactcggaaaagtgtgtctggagcatggcattctgatcgtttccgacgagatttatgagaagcttacatacggaggaaaaaaacacgtctcaatcgcacagctttcagataaattgaaagagcagacgatcatcattaacggcgtgtcgaaatctcacagcatgacgggctggaggatcggctatgcggcgggttcggagacgattattaaagcgatgacgagccttgcgagccacagcacatcaaatccgacgtccatcgctcaatacggcgccattgcggcctataacgggccggctgagccgctggaagagatgagacaggcatttgagcacagactgaacaccatttacgctcagctcagtgaaattcccggattcacctgtgtcaagcctgaaggggcgttttacttgtttcctaacgccaaagcggccgcagaaaactgcggattcaaagatgtcgatgaatacgtcaaggcgcttctggaagaagaaaaagtcgccgtcgtgccgggctcaggcttcggctcaccggacaacgtccgtttatcttacgcaacgtcactcaatcttttagaagaagcggtcgaaagaatccgccgcttcacggaaaaacacagctgattctgaaaaagcggcttttaaagccgcttttcacttgcattgaccccgttagagtagaacgggtataataaagtgatgaaaaaagagattcaggcagattcctgaatgtctttcttgttctggagggaaagagtttgaaaacaacaatcaaccaagtgtataaacacacaggcgaggaagtaacgattggagcttgggtcgctaataaacgctcaagcggtaaaatcgcatttttacagctgagagacggtacaggcttcattcagggagttgtcgttaaagctgaagtagaagaagacatcttccaaatcgcgaaatcagtgacacaggaaacgtcactttatgtaaaaggaattgtgaaagaggacgagcgttcaccgctcggctatgagcttgctgttacatccattgaagtcattcacgaagcgactgattatccgattacgcctaaagagcacggtacggaattcttaatggatcacagacatttatggctccgttcgaaacgccagcacgcaattatgaaaatccgcaacgaaatcattcgtgcgacttatgaatttttcaacaaagaaggcttcgtgaaagttgatccgccgattttgacgggaagcgctcccgaaggcacgactgagctgttcgcgacgaaatattttgatgaagacgccttcttgtctcaaagcggccagctgtatatggaagcagctgcaatggcgctcggaaaagtattctctttcggaccgacgttcagagcggaaaaatcgaaaacgaaacgccatctcatcgaattctggatgattgagcctgaaatggcatttgttgaatttgaagaaaaccttgaagttcaggagaattatgttgcatacatcgtacaaagtgtgctggaacattgtaagatcgagctgaacacattaggtagagacacatcgaagcttgaacaaatcaaagcgccattcccgcgcattacgtacgataaagcgatcgaattcctgaaagaaaaaggctttgacgatattgagtggggagatgacttcggtgcgccgcatgaaacagcgatcgcagaaagctatgacaaaccggtgtttatcactcattatccgacgtcattaaaaccgttttatatgcagcctgccaaagatcgtgacgatgtcgtgttatgtgccgacttaatcgctccggaaggctacggggaaatcatcggcggttcagaacgcgttcatgatatggatttattggaagaaagattaaaagaacacggtctggattcagatgcttacaaatggtatgctgaactcagacaatacggttctgttccgcactccggcttcggcctcggacttgagcggacagtggcttggatcagcggagcgcctcacgtgcgtgaaacgattccgttcccgagacttctgaaccgtctgtatccgtaatagttatgaaaaacgaagtctcctgcaagggagactttttctaagtaaaggggaaaactcccggagataaccttttacagtaagaggtgtaaggatgaaaaaacagcaatttatagatatgcaggaacttggcatttcaagcattcccaacctgctgttgacacattaccggcagctcgggctgaatgaaaccgaattgatcctgcttttgaagattaaaatgcatttggaaaagggctcttattttccgacgccgtttgaacttcagtcaggcatgtccatctctgctgaagaatgtacaagctgcctgagaatgtttattcaaaaaggttttctgtttattgaagaatgtgaagaccataacggcataaagtttgaaaaatattctctgcagccgttatgggcgaagctgtatgattacatgcagcattctcaaaatgaaacgcaggaaagaacgtcagaaagagaacaaaaaagcctgtataccatctttgaagaagagttcggaagaccgctgtcgccgcttgaatgcgagacgctggccatatggcaggaccaggatcagcatgatgcgattctgattaaacacgccttaaaagaagccgttttatcggggaaactcagttttcgctatattgaccggattttatttgaatggaaaaagaacggcttcaaaacggttgagcaggcgaaggcgcacagccaaaaattccggcgtgttcaaacgaaacaaaacgatccgcaaaaagagtatacgaggcaggtgcctttttacaattggctggaacaataacatgagaaggggagaaacgtgttaaatttaaagcagattgaatattgtcttgaaaaaatcggcgatatgtttccgcacgcagaatgtgaacttgtccattcaaatcctttcgaattggttgtggcagtcgcattatccgcgcaatgtacggacgctctcgtcaacagagtgacaaaaacgctatttcaaaaatataaacggcccgaagattatcttgccgtatcgctggaagaactccagcaagatattaaatcaatcggtctgtaccgtaataaagccaaaaatattcaaaagctgagcaaaatgatcatcgaagagtacggcggagaagtgccgaaagaccgggatgagcttgtgaatctgccgggtgtcggacggaaaacggcaaatgtggtcgtgtctgttgctttcggcgtacctgcgattgcagtagacactcatgtggagcgggtctctaaacggctcggtatctgccgctggaaggactctgttttggaagtagagaaaacattaatgaaaaaagtgccgaaagaggattggtctgttacgcatcacagattaatatttttcggcaggtatcattgtaaagcgcaatctccccgctgtgcggaatgtcctttgcttccgctatgcagagaagggcagaagcgtgacaaaaaagggctggtgaaacggtgacggcgattgacattctggcaggctatgaaacatacctgcgcagccttacggacttggaaagccttgagatcaaaacggcgctgcgccgccatccgctgtatatggatttcagcggtcagccaaccgtgcagccatggagggaaaggggcgaatatgtcccgtttctgtttcaagtttggaatgaaacgaaagaaacgctgcttcccgtttttcaaacaagaaaatcgagatgtgatcaaaatgacatgctgaagggaattgcctgtctgattgccgcttttcactggacggcaggggagcgggtcacatcactcgattggtctgtgcttgaaacaaagcattttcccgccgaaccgatcaattgggcggagcgaatggcgtttattttaacaaaaccgactcaatttcactcctttattcagctggatgaattgatgacggagatgaagaaacaatatcataaatatgaagtcatgaacaaaagttaaaaacctccttttcttataaggaggtttttttgtatgaaaaaaatccttcacctgtttgaggtgaaggatttcgtccgccgctaatgagcggaatttgactggatggttgacgaattggactgcccgttgatatttgaagatgagtcttggtttttgtccgtttgaccgctgtcaggtttatttgagccgtctgaaccggaatcggaatcattatcagggccgttatcttgctgtccgttgttatcggtcccgttaccgggctgattctgattgttgttatctgtttgatccttatcggattgatcctgatttttatccgggtcatcagttggtgtttgatccgatccgtcagacgtatctgtttgattgtcatctgtgtttgaatcatcggtttgcgtcttgtccttatctttatcttcatcagatttctgttcatcgtcagtcgctttatctttatctgcatcgtcttcttcatctttcgggactttgaaagatgctgatgccgtatcgctttttccgtcatcgttttccgctgtcacctggaagctgtatgtggagcctggtgtgacatctgagacgacggcttcttttgccgaactgttttgaatgtcactgtagcttccgccgtcaacggattgtttgacattgaatgttgcatcaccgtcataatcccagcttaaggttaatgattttttatctttgtcgtatttcacttgcaatcctgtcggtttatcggctttttctttcgtgtacgttttagaaacggcagttggctgcgttcctttcacgaagtactccgtcacttttttatcatccggcgtattcggtccggctaaagcggcaggattcgagcctttctcaactgtttcttttacgacgctgtcaggctgcttgaagcttcctttaccgtcatcaacgtaagagatcagcttttggaaaatccgttttgcgacttgctggtctgcagaagacagtgatttcttgcctgctttgttgccagactcaactccggtccaaaccgccgctgtatattgaggggtgtatccgacaaaccaggagtctgggactccgcctggagcaatgttatatttttgaatgtcctctttagtaaagttggtcgtacccgttttaccggcgacttccacgttcggcacctgagccagtttacctgttcctgattcgacagctgatttgagcatatcggtaatcataaacgctgtgtagtcgctcatagcacttttcggtttcggtgttaaatcaagcttagtgccgtcattaaattcaatcgatgtgaccgcgtgcggttcgttgtacgttccgttatttccgaacgcactgtaggcgcctgccatggtcatagtagatacaccgcggttaccctcaccaaatcccccgatagagtagggttcatatacttgatctttgtttaatcccaatcctaagtcgtttgcgaagtcgacggcattatcttttcctgctgcttggtatgcttttaaagcaggaatattacgtgagtctgcgagggcctctcgcatagatatctgacctctgtatttattgtcccaatcatgaatcggtgtgccgtcagagtacgtataagctgagtcgtcaatctgctcgtaagtcgaccattttttattttcaatgaccggcccgtaatcaagaatcggttttatcgttgaaccgggctgggttttaccttgtgttgcataattgaatcccccggcagttctgttccgtcccggtccgatggcacggatttctccgtttgtcgtatcaaggagcgtgacgcctccctgcatgccttccgaaaagccaaccgtgtctccgttcatcaattgatcaagataatcttgtgccttcgtatcaagagtcgtgtaaattttcagtccgtcagttgaaatattgacgtctttcttttcttttgtctcaatttctttcataacttcttcgacaaaagcgctgtatttatttgtgtcctttttatcgtattccttttggctgacgacgccttcatctttcatggacactttctttgctttttggtagtcagaatttgaaatgaatccttgtttttccattaagctgagaacaatgtttcggcgtttttcggaagccttcggatttttaaccgggttatatccggtcgggctttgcggcattccggcaagcgtcgccgcctgttcaaccgtaagcttgctcaaatcttttacgccgaagaattcttcagccgctttaccgacgccataggcacgcggtgagaaataaattctgtttaaatacatttctaagatttcatctttagaataatggcgctccagctgcagtgaaagccacacttcctgtgctttccgtttaatcgttttctgatgggtcaaaagtgagtttttcacaacctgctgggtgattgtgcttcctccctctgaaccgaatccatccgtaaagttggcgaccaaggcgcctccgatccggatcgggtctataccgtggtgcttataaaaacgggcgtcttcagttgcgataaatgcttctttcacaacatcgggtatatccttaatcgggacgtaggttcgtttttcaccgcccacttccgcgatttctttgccgtttttatcgtaaatcgttgaagagtaaggcgttttcagcttggcttcgtccaaagacggcgcgccggaaaccaaaacggcaaatgccgccgctccgccgactatgcccaggacaaacagaataaccaaggacagtacaatctttttgaataaaccgcctttacgctgtttcttgccttttttcggtgaagagggcttagtgcttttcgtctgccttgccttacggcgttcttcacggctcgtaaattgatctgacataacatctcaacctttcgtttatcaacctttcgctcagtctactgttcctgcgaaaaataaagctgttcaataatactaatataatcaattctcggtgagtatccaagggaaatcggaaaggaagcatcttctaattcgtctttgcgaattgattttctgccattgttctcctttctctcccaaaagacaaacagcttgtcggcttcgaggaaataaacctttccgaaagcggatataataacaaaacaaatgccgtcttgtctgaccacctgcttcatatgctcaatctgatgatcatgaaaattctgcaggggaaatgccgttttgttttttgtttcttttgcctcaaaatcaatgtagcgccctttataaatgccgttgtagtcagttgtggaagactgtttaaaataagcttccttaatgactgcggcgcttcttttcggatagtggacgtttacaatctggacgggtgtcggctttttgtgaatgacagcaatttggttagccagataatacttattcgtttcattcaggtcgtcttcgagggtcatgccgcgattactgtatgaatgggaccgtttctggctgttttgggatgaaaccgttttgttcggctgaaaagtttttccattcgggtaccgaatcactttttccatcctccttatcaaactaatagtgacggaagtgaatgaacgtgcataaacgacagaccgtaaccgccattcttcgcctgatcgaaaaagagacgaaaataaaaaatgccgataatatttcccggacgaatgcctataaagcatattatgaccgccatcctgagatcaagtggccgcttttggcatcgtttgtgtcccgcaatgcgggctggtcgatgactgatttaagaggcgtcctttatcaggagggccttgacagcagtcagaaaaactggtttttcctttcgtatgaaagggcgaattggctgattttttctgatgcctatcctcagcttctggtctaccagtggtcaaaacaaatcggcgaacctcttttccgtcatcttccttatttccgcgtctcggcttttatgcaggaagaatggttccgcttttggcgtgacggagatacggaacggctcatgtatgctcttattataaatgaacaaaacactatccaagcacctattatacaaaatccttcgtttaaaaagaatgtttttggcacgattcctttttatttaagtgattgttttcactttaatacggtgatattcccttcatttgacggacatttatacggaatttccgtcaaacggttttcaaaaaccgaagaaagaattacgctcggaaaacagctggcccgccttctgttcagccctgatcttcacgcttctttttaccgttttcttgataccgttcctcataccggttcacgctttgatatggagaaaatgatcggcatcaaaaaaagaacatcaccgatgctgaggacaacctatcccattgttgcccacccattagacggcgaaagggcggattggtttcaaaaaaggttaagaaaaggggctttcttacaggagaaaatgccgaaacagcttgaactgacggactggtacttccagaaaagacgggagctccatgcgctcttcgcggttaaagagtggctgaagaaatgaaaaagcccgaaaccgttcgctggggtttcgggctgctgatgtgttacgtggaagggcggtttgggccgcctaattttttatcaagcgtatcagtcgtttttgcttcggttttttgctgtttacctgcatttttcggtctcgttttcatacggcacctcctcaactgtatcgtttgcattaacgtgccggttcatacaaagtttgcggcacttttttgtcgaaaggcacgccttttaggataatctctgtttgtttgccgaactgcttctagttttgtcatgtgcagaggagagcggtatgaaaacgagaattatattctaaagagacgcaagtgataaaagggaggaacatgaatgtctgtttacacgagcaaggctgatattctccgtctgctttctgatattgaaatccggatttctgctgctgaaaagacgcttacccaagcagtcagatcctgtcaggcggaagctgaagaaatcagacaggagaaactttcccgccttgaggaagaggcgcgggagcttcatgtttgtattgatgacctgtttttggctgaccggcgtaaaaaggatttgccgagagcctgccggatcagctgattttatgcaaaaactttggtaccatatgtactgaggtgagtccgtttgcagacacagtcgttattggagctgacagaacaaatgatagaggcggttctggaagccgaaaaaaggtatcaggatggaaaagagtcaggccgttcatatgatttttttgagattataaaacccgatgttgaaaaaagagaccggctttgcgcgctttggacagaagcagcacttgcgtttattcgggaaaaccgtccgaaatacgttcatcacgcacaaattcaggccgttacagaaaatttcggagagctgatgctccaatcatatgttcatcatattcataaaaaaagatacagggatttaactgaatctgttttatatacgcttcgtatattaagggatgaaattgaaaaagaaggcagctgaaaacggctgccttcttttatataaaggggtcgggtatgttattcatacgccgggttttctgctccacttgcttcgagaaccttcatactgtttcgaaattcggttgcggtgagatggccttgaatatagaggaattttgcaaagtccatcagtttatctgcacaatctgtttcatattttttcacttcagcaaaacgctttcttaagtatgatacgttcataatggtgcatcccctctcatgtatgttgagattatggtaacataacgattcgacttttttctgtttttaaaaaattaagactttcgacagcatttgacaaaaatcagaatcaccgaaagcacataaccacggcggaattcatacatatatagcagaaacttagtgagagacaagggggaatgtcatatgcaatggagagcgcagccatatcaaaatatgtaccagcagccggcgggatatttctacccgcagcagatacagccattacagcagccgagtccgcagcagatacagccattacagcagccgagtccgcagcagatacagccattacagcagccgagtccgcagcagatacagccattacagcagccgtatccgcagcagatacagccattgcagcagccgccctatcatcagcaagggcagtacccgcagcaattttatccgaatcaggaatacggtcatatgcagcagccgtttgctccctctcctcctcaggcaggcatgcccggggggcagccggggtttgtgaatccttaccccgttcccagaccgaatcagcagcagtcttcccaattctcaggcatactctcccagtttaaaaaaacgaacggacagtttgactttaataaaatgatagatacaacggggcagatggtaagcgccgtaaatcaggtcggatcgctggtgaaaggcttcaccagtatcttcaaataaaaagcatgaatgatatccatcattcatgcttattttttagggaaaaagagggtaagcgtctgttcattccaggatgtttccatatcttcttcactcaccttatacgggaggacaacggttcttgtcatgcttgaagacacatgggatgaatgagcctgtttatgatcgtagcggattgtaacgtgaaggtagcaccccttcgtttccaccagcatatcaccgtcacggaatgtctcgggaacgctgatatcaaccgcgaggcccgtcggctcttctctgacgtcaatcgtcacttgcgcttcagtaaaagccgaattgacaaggtgctgaaaaccctgcatcaattctgcgaagggacctgagtgaaaaaattggtccatcgcatggctgatgatgtcctcatttctttgcggatcaagtttatcgttttgtgattgatccatatgaccaccgcctttttacaaacagactatgcgatgttatgccgtatggttaagaattgaaggaaaaaagaaagtatggttaaatagtggagaataaactggtaacggattcacatttaggaaggggagcacaacacattgctgaaaaaattattcggattgggagacagccggaaaaagccggccgaggaagtgattttttctccggctgacggagcggtgatggatttggcttcagtgccggatcccgtattttcacaaaaaatgatgggggacgggattgccgtcgagcctgcaaacggagacattgtttcaccggttgagggagaagtgattcagctgttccatacaaaacatgctgtcggcatccgcaccctttccggagcggaacttttgatacatgtcggtttggataccgtcaatatgaacggcgaaggctttgaagcgcatgtaaaagaaggagacaaagtgaaaacaggcgatctgcttttaacgtgccggctggatttaataaaagaaaaagcaagcagcaccgtcatccctatggtgattatgaatggcgatgccgcagaacctttgcaatttgcaggcgcaaatgaagcgaaaaaaggacaaacagagctttttaagataaaaatgaagtaggcaggggctgattccctgctttttttcttgtgcaggattttcatctagccaggcaaacaaatattcggtaaactgtacctcataaagaggtgtgaacgatgaagaaaaaatcattgagcgaactgattcaggaattaaaaaatcatgaaaatattgtgcattggcatgaagaggaaccgcgggaggcgaaaaccatgccgatgccggagcaagtagatcggaaaattcgggcggctctcgaaaagagggggatcgagcggctctttacacatcaatactccgcttttcagacggttcaaaacggagaaagcattgtggctgtcacaccgacggcctccggaaaaacactgtgctataatcttccggttcttcagtctatcgcggaagatgcctcaagccgcgcgctttatttatttccgacaaaggcgctcgcgcaggatcaaaaaagcgagctgaacgaaatcatagacgagacgggcatggacattaaaagcttcacctatgacggagatacgtccccggccatcaggcagaaagtcagaaaggccgggcatattgtgatcacaaaccctgatatgcttcattcagccattcttccccaccatacaaaatgggtgagtctgtttgaaaacctgaaatatatcgtcattgatgaattacatacgtaccgcggcgtattcggcagccatgtggcgaacgtcatccgccgtttaatgagaatctgcgctttttacggaagcacgccgtcatttatctgtacatccgccacaatcgccaatccgagggaattggcggagcagctgacgggaaaatcagtgcgcctgattgacaataacggcgccccggccggaagaaagcactttgctttttacaatcctccgattgtaaataaaccgctgcatattcgaaaaagtgccaccgtggaagtgaacgaacttgccaaaacttttttaaaaaataagatccagacgattgtttttgccagaagccgtgttcgggttgaaattattttaagccacattcaggagatcgtaaaaaaagaaatcggtgcgaagtctgtcagaggttatcgcggcggatatcttccgaaagaaagaagagaaatagagcgggggttaagagacggaagcattctcggcgttgtcagcacaaacgcgctggagctcggcgttgatatcggccagcttcaggtctgcgtgatgacggggtacccgggcagtgtcgcgagcgcatggcagcaggcgggccgagccgggcggcggcagggagaggcgcttatcgtgatggtggcgaactctgatccgattgaccaatatattgtgcgccatcctgattatttctttaaacgctcgcctgaatctgcaaggatcaatcccgataatctcattatattggtcgatcacctgaaatgcgccgcgtatgagctgcctttcagagccgatgaaacattcggagaaaatgatgcaagagacattctcgagtatttagaagaagaaggggtgcttcacgaaaaccgcgaacgctatcactgggcgagcgaatcttttcccgcctccaacatcagtctccgttcggcgtcacaggaaaacgtggtcatcgttgaccggtcagagacggctgatgtaaaaatcatcggagaaatggaccgcttcagcgcgatgacgcttcttcatgatgaagcgatttatcttcatgaaggggtgcagtaccaggttgaaaagcttgattgggatcataaaaaagcgtacgtgcgaaaggtcgatgtcgaatattatacagatgccaatttagcggtgcagctgaaagtgctggacattgacagaacggacagcagaaagaaaacggccttacatttcggcgatgtaaccgtgaacgcacttccgacaatatttaaaaaaattaaaatgacgacatttgaaaatataggatcagggccgattcatcttcctgaagaagaactgcataccagtgcagcctggcttgaattaaaagagacggattcggagatcggcgaaaaaacgcttgaacagctgcttttaggcattgcccacgtcttgcagcatatcgtgcctgtatacgtcatgtgcgaccgaaatgacgtgcatgtcgtgccgcaaatcaaagccgcacatacgggacttccgacaatctttctgtatgatcattatccgggcggaatcggacttgccgatgaagtatataagcgatttgatgaaatcaatgaaggggctgagcgcctgatcagacaatgtccatgtcaagacggatgtccttcctgcatcggctccgaaatagaaggaatagatggaaagaaagcgatactccggctcttgaattacgtgtaaaagaaaagggggacgaaagatgtccttgaaaaataaattaaagcggatgaaaaaccacctgaatgtgccggaagctgaaaaaaagccggcagcttcacaactttcggtcccggatattcaagtcccatttagagaagaatgggaggcattcggagtgaagcctttcttttttgaggatgaatactgtcttatccgcgaaaccgtctatccgctttcgcaccgccacggacggtacagcttcagtgaacttgatgacgtcatggcattatggaataaaggcggtttgacacatactttatcagcagaaggatacgaaaaaagccagctgttcttctttgatactgaaacgaccggcctcggcggcggggccggcaatatgatttttttgctcggtcatgcaagagtgtatgaagaccgtgtcgcggttaaacagcatctgcttcctaaaccgggaaacgagacggctctttacaaaagctttttaagtgaggttgacattacgtcccttgttacgtataacggaaaagcctttgactggccgcaggtaaaaactaggcatacattgctgcgggacaggcttccgaagcttcctgacttcggtcactttgatcttctgcacggggcgagacggctttggaaacataaattagagcgtgtatcgctttcggcggttgaaaatgaagagcttgcttttaaaagggacgaagacacacctggttatttggcgccgatgctgtattttcaatttttaaaggcggaggatccggctcttttaaagggagtgctctcgcataatgaacaagatgtgctttccctcatcgctctttacatccatatgtcaaaaaagatttttgcatcttctgatcagacgtcagaacgtcaggaagcatacgccatggcgaaatggtttatcgctcataaagaaaccgatcgggctgtttcacagctggaagcgctgcaaggcaaagactttgaagattcggatcgggccctttttgacttagcaatgctttataaaaaacaaaaccgcaggcaagacgccgtgcccctttgggagaaactgacgggctctgatcttcacatatgcagacaccaatcagcggtagagctggcgatctattttgagcatcacgcaaaagattataaaaaagctctgcaggccgcacagcaggcggcagaagacggggaaatatcggaaaaagaagccgagaagctccatgtgagaattgcccggcttaagaggaaatatccttcttgaaatattgcccgggaaagcgcaaaagccgagctgtttcgccaaaaatatttttttctgaatccgcatcgattttgttgtagaatggtgccgcatcttgtaaaatagcgttagttatttataggggagagttggtatgtataaaggtgttttttacttgttctttgtcgtggtttttttgattgcgtttgtattttcgaattttaaagacagcttgctgacacacttttaaattgggtgattgaattagaacatgcaccctcttttcttcataacctaacagtgtaatataagttaatggagaggggatttagcatgtttcatcatcattgttgcagaccaaacgtgatgccgccgattgtccatccgactcattgctgtgaacaccattgtttttctaacacagttgtgccgcatattcatccgcaacatacaactaacgtaaatcaccacaactttgagcacgttcattactatccgcacactttttcaaatgttgacccgacaactcaccagcattttcagtgcggaagcccttgctgcgatcattagtattgaacgcttaagcaagatcggttaggatatcagcaaatcaaaatggggcccgatggggagccccattttttaagcaggtgatcaattgaaagtattagccgtaacaggatacaagccgtttgaactcggaatttttaaacaggatgaccgggcgcttgtttatataaaaaaggcgatagaaaccagactcagaagctttattgacgaaggcttggaatggattctcatatccggacagctggggactgagctttgggcggctgaaacggcgtacgatctcagagaagagtatccggaattaaaggttgccgttatcacgcctttctacggccaagaagaaaagtggaaggaaccgaataaagaaatgtatgaagcggtgcttgctcaggcagattatgaggagagcctgacgcatcggccgtacgaaagtccgctccaattccggcagaaaaacgcgttctttattgaaaagtcagatgcgcttttgcttttatatgatcctgaaatggaaggatcgccgaaatatatgctgcagcaggcagaaaaacgccgtgaaacagacggatatccgatttattcgattacgatggatgatctccgtgccgccgttgaagaagaagatttctttacataacacgtcagagaatatttgacaacgggacgtgtttctgaataaaatataacatgatgattcacgatatgaggtgaaaaagatgcttgctgataaagtaaagctttctgcgaaagacattttggaaaaagaatttaaaacaggcgttagaggttacagacaagaagacgttgacaaatttttagatatgattattaaggattatgaaacctttcatcaagaaattgaagaactgcagcaagaaaatctgcagctgaaaaaacagcttgaagaagcaagcaaaaaacagccggtgcagtccaatacgaccaactttgacattctgaaaaggctgtccaaccttgagaaacatgtattcggcagcaaactttatgacgaatagggcagatgcacttgtcaaatgagacaagttgctttataatgaacaagtgttcttaacgttcgggtaatcgctgcagatctttgaatctgtagaggaaagtccatgctcgcacggtgctgagatgcccgtagtgttcgtgcctagcgaagaaataagctagggcagccttgataggctgacggcaggaaaaaagcctacgtctccggatatggctgagtatccttgaaagtgccacagtgacgaagtctcatcagaaatggtgagagtggaacgcggtaaacccctcgagcgagaaacccaaattttggtaggggaaccttcttgaaggaattgaacagatagaaggacagaatgctttctgtagatagatgattgccgcctgagtacgaggtgatgagccgattgcagtacgacggaacaaaacatggcttacagaacgttaaacattattgatatgacaaattagagctctcctttaaaggggagcttttatcttgaatgagacgaaagcttaaaagagacagggtgatacgatgaagaagtacacactaatagcgacggcgccgatgggaattgaagcgatcgtcgccaaagaagtgcgtgatttaggttatgaatgcaaagtagacaacggaaaagtcatttttgaaggagatgcgcttgcgatctgccgcgctaacttatggctgcggacggctgaccgcatcaaagtacaggtcgccgagtttcaggcgaaaacgtttgatgagctgtttgaaaaaacaaaagcgattgactggcgcgcgtacattccggaaaacgcaaagttccccgttatcggaaaatccgtgaaatcagtgcttgccagtgtgcctgactgccagcggatcgtcaaaaaggcgatagcggaaaagctgaaacttcaatcaggaaaacaaaatgaatggattgaagaaacgggccccgagtataaggtggagatttcccttttaaaagataaagccgtgcttacactggattcatcaggaacaggccttcacaaacggggatacagggttgatcagggaggagctccgattaaagagacgctcgctgccgcgttaattcagttaaccaactggacgcctgaccgtccgttcgtcgatccgttctgcggttccggcacgatcgccattgaagccgctttaatcggacaaaacattgctcccggttttaaccgtgattttgtttcagaagactgggaatggatcggaaaagaactgtgggacaaggcgcgtcttgaagtggaagaaaaggcgaactatgatcagccgctgcagatctttgccagtgacgtagatcaccggatggtaaacatcgccaaagaaaacgcagaagaagcgggactcggtgacctgatcgaatgcaagcaaatgcgggtgcaggattttacgacgaaactcgaatacggcgtaatcgtcggaaaccctccgtacggcgaacggctcggcgaaaaaagggaagtcgagcagatgtataaagaaatgggccgggcatttgaatctcttgatacatggtctgtctacatgttgacgtcaaatgaacaatttgaagaggtctacggaagaaaagcaaccaaaaaacggaagctctttaacggttttatcaaaacggattattatcagtactgggctaaagtgcggccgcagcggaaaaagccgcaacaaagagaagacgcctgaaacagcgtcttctccggcatctttacgttttattctgccattaccagcggtgcgcttttgcgttgctccgtaaaataatgttggtctgggacatttcggtgtggccgttcacttgcgatttagagcgtttcggccgcgtccaattgtgatgaaacaattcagaatgctgatctaatcgatctttataactcatgtaaccatcactcccggatagaataattttgtgaagatggatattcgatcgaatatctgttgtagtttgtgcaggtcaggtgcggatcattcagaatggcatgtatagaaagtgaagcatcggcatagaatgatgattatttctatttgagaggtgatctattttatgctgaacagcgagcacttcagtaaaatacaaaaggcgttagacgcaactgctttccggctggaggaagccggagcggagttcggtccttccgccatgacacacgcacaggaagaacttgaaaatgcggtaaaacatacacattcaacagaccatccgttcctatgtacacatatcattgaccggaaatgataatggcaaaaacttggcgaggccaagtttttttgttgtattgaaaagggttaaatgatattatagatggtctgaatgccgaatagttaggggttggagttgggtgacaacatcacgtttgccttttgctttaacaaaagaaaagaatttttacgaagaattgaacaattggattggtgacgtgttttacgatatccttcccgagaaaggctttgaccttcgggatgagcaggtatttatggcgtttcagcttgaacgggcatttaaagagaaaaaagtcatgttcgctgaggcaggagtcggtacggggaaaacgctggtgtatctgctgtttgccatcagctatgccagatatacgggtaaaccggccattatcgcatgcgccgatgaaacgttaattgaacagcttgtcaaaaaagaaggcgacatttccaagctgacagaacatttggatctgcagattgatacacggctgtccaaatcccatgagcagtatttgtgtctgaaaaagcttgagaaaacgatgcagcgttctgatgatgaaaagtggctggatctttatgagtcgctgccttcattcgtacacgagtcacaagcgatgcagcgcttttatccgtacggcgaccgcaaacagtacgctgatttgacgaatgaagagtgggcaggcgtcagctatgattccttccaagattgtttaacttgtgatatgagacatagatgcggtttaacactttcgagagatcattacagaaaatcaacggatctgattgtttgctcccatgatttctacatggagcatgtatggacggaagaatcacgcaaaagggaaggacagctgccgcttttgccggatcacagcgccgtcgtatttgatgaaggacatctgctggaattcgccgcgcaaaaagcgttaacgtatcgtgtgaagcagtcgacgcttgagctgtttttagagcgtctgcttcaaaatgacatcagagaggaattcgccgaactgattgaagatgcccttgccgcaaacgatgagtttttctatgtgctgtcagaggaatcgaaggaaatcgcaggctctcaccgattggacatccaaaacgaccagcgtgttaagcgtgcggctgacgaactgtgccgtctgctcgataaaatcggcgaggcgctcgtatttgaatcggaaatgtatacgatcgataagtacgagctgtcagttgtagaagaatacgtcgaacaaatggcatattcgctgtcgctgtatcaaaaggatgccatcagctggcttgaaacgcgggatacagactcaacgtttgttgttatgccgagaactgtagccgaagttttgggagaaaaggtcttttctaaaaagattccttatatcttctcatcggccactctttctgagggcggttcatttgattatatcgctgacagcctcggaatccgtgatcctttatcattcaccgttgaatctccgtacgattacgaggagcaaatgtctgttgcgcttcacggtgacatgacgtctgagcagaaaacagccgaaacgattgaaaccattaagaagaatgaaggacgcaccctcgttcttttcccttcctttgaagacatgaaggaatttaaagaacaggctgccgcgtgggagctgccgtatccgatatactacgaaggtgacgaagagatctccagtctggtcgaaaaattccagcgggatgaagaatccgtgctttgttccgtccacttatgggaaggtcttgacattcccggtgactcgctccggaatgtgaccatttgggcgttgccgtatccgcctcatgatcccgtgtttaccgcaaagcggaacggagcgaaaaaagatccgtttgaggaagttgatctgccgtacatgctcttgagagtccggcagggaatcggccgcctcatccgttctaatcaggacagcggaaccatatccatttatgcgggcggagaaagtgaacgggtcttggccgaagtcaaaaagatcttgcctgttacaccgaaaatcgtataaaaacaaaagctgcaggattcttatcctgcggcttttttaaatccgggaagttgactttatcacggcattccattagcctgtaattgatagtgaaaagggaggggaacggatatggatttacatacatatgaaaaagagttttttgatctgttaaaaagagtatcccactatgtcgaagccattgcacttatgcattgggacttaagaacgggagccccaaaaaaaggctctgatgaccgggcggaaagcatcggacagctgtcggctgacgtttttcaaatccagacatccgaccggatgaaagagctgatcgacatccttctcgcgcatgcagaggagctctctgaagatacagtgaaagcggcggaacttgcgaaaaaagattatgatcataataaaaaaattcctgaagatgagtataaagaatatgtcattttaacatcgaaagctgaaacggcttgggaggatgcaaaggctgcctctgatttttctatgtttgctccgtaccttgagaagctgattgattttaataagcggtttatttcgtattggggctatgaagatcatccatacaacgcattgctcgatattttcgaaccgggtgttacggtaaaggtgctggatcagctgttttctgaattgaaggaagcgattattccgcttatcaaaaaagtgacggaatccggcaataaaccggacacttcctttataacgaaaacgttttcgaaagaacaacaaagagccctctccttgtatttcttaaaagagttcgggtatgattttgacggcggccgcctggacgagacggtgcatccgtttgcgacgacaatcaaccggggcgatgtgcgggtgacgaccagatatgacgaaaacgatttccgcacggcaattttcggaacgattcatgaatgcgggcatgcgatttacgagcagaatattgacgaagcgctgagcggaacgaacttatctgacggtgcatccatgggaattcatgaatcccaatcgttattttatgaaaactttatcgccagaaatcaacatttctggaccgcctattatgaaaaaatggttgaggcttcgcctgatcaatttcaagatgtgaaaagagaggactttgtacgcgccgtaaatgaggcgaaaccgacatttatccgaattgaagccgatgagctgacatatccgcttcatattattatccgttatgaaattgaaaaagcgattttcagcaatgaagtgacagtggaagaactgcctgcattgtggaatcaaaaatatcatgattatttaggcattacgccgccatctgacgcaaaaggcattttgcaggacgtacattgggcgggcggagatttcggctatttcccttcctatgcgctcggatatatgtatgcggcacagctgaagcataccatgcttgaggatctgcctgaatttgaccaattaatagaacggggcgattttgagccgatcaaacaatggctgacagaaaaggttcatcagcacggaagacgcaaaatgccgcttgacatcataaaagatgcaacgggagaagagctgaacgttcaatatctcattgagtatctcgtcggcaaatattcaaatttatatttataaacgaaacgcccggcatacaccgggtgtttttctaaaaattctaaaaacacgaataatcgaaaaccaattctttgtaaaagttcggaaatattcaaatttcactatgcaaaagaagtgtatcttgttataatttgattaatatcatacgaacactcatataatcgcgtggatatggcacgcaagtttctaccggtcaccgtaaatttccgactatgagtgagcaatggaacggctttattcggccgttgcgtgtagatcattcggcattgcttgctctttttttggagagcgggcaatgctttttttattttttataagcgggggtaatcattgtggaagcattaaaacgaaaaatagcagaagacggaattgttctttctgatcaagtgctgaaagtggattcttttttaaaccatcaaattgatccggttctcatgcagcagatcggccgggaatttgcgcgccgttttgaaaaagacgagataaccaaaatcgtcacaattgaatcttcgggcattgcccctgcggtgatggccggccttgaactcggcgttcccgtcatctttgcgagaaaaaggaagtctctcacattaacggatgatctgctgacggcatccgtctattctttcacgaaaaaaacagaaagtcagattgcaatctccggaaatcatctgtcgaaagatgaccgcgtgttaatcattgacgactttttagcgaacggacaggcggcagaaggacttttatccatcgtaaaacaagcaggcgcagcggtttgcgggatcggaatcgtcattgaaaagtcatttcagccgggaagagatgagctgatgaaaaaaggatgccgggtcgaatcactggcgagaattcaatcgcttgaagacggaaaagtgacatttgtacaggaggtccgttcatgaaaaacggctatgccaaaacactttcactcggtatccagcacgtgcttgccatgtatgccggcgccgtcgtcgttcccttaattgtaggagcggcattgggactgaacgcagaacagctgacatatctcgtatcaattgacatttttatgtgcggggcggctacgctgcttcaagtatggaggaataaatgtttcggcatcggcttacccgttgtgctcggctgtacgttcaccgcggtagcgccgattatttccatcggtaaggagtacgggatttcagccatttacgggagcattttggcatcgggtctgcttgtcattctgctgtcgtttttcttcggcaagctcgtatcctttttcccgcctgtggtaaccggatctgtcgtgacgattatcgggatgaccttaatgccggtcgcgatgaatcatattgccggcggggaaggcagcaaggatttcggtgatccggctaaccttgccctcggatttacggtgctcgtcatcatcgtgctgctttatcggtttacaaaaggatttttgaaatccatttcgattttaatcggcattgtcatcgggacggccatcgcatattttatgggaaaagtgcaatttgacaatgtggcgaatgctgacgcaattcaaatgattaaaccgttttacttcgggacgccgacatttcatgcggcaccgattattacgatgtccatcgttgccattgtcagccttgttgagtcaaccggcgtctatttcgctctcggtgacctgacaaaccggcgcctgtctgaacgtgatttagcaaaaggctaccgcgcggaaggcctggcggtattcatcagcggcatttttaatgcttttccgtacacggcttattcccaaaacgtcggcctcgtgcagctgacaggaattaagaaaaacgcggttatcggtgtcacgggcgcacttttaatgctcttcggcctttttccgaaaatcgcagccttcacgaccataatcccgtcttccgtactgggaggcgcgatggtggccatgttcggcatggtcatctcctacggcattaaaatgctcagtcaaattgactttaaaaagcaggaaaaccttctgattgtcgcgtgttcggtcggattgggactcggtgtaaccgtcgttcccgatatgtttaagcacctgccgtcttacttaaatctgctgaccacaaacggaatcgtcgccggaagctttaccgccgtccttttgaatattatttataatatgattcccaaaacgaaaaaaacccttgatgtgacaagggttcaagagggttagtgatccgttttctttaaaataacatcttattttatctagatcgaggatgcttccgaaagtttgctgaactttttgcgaggcatcctctttcatttattattttcattgtttgaatagaaacaaattgagtgatgaggcatccgccttatttcgccgaaaaaccgtcccgaactatatgtacgtgaacgagtatcttgtgcacgaattcttacaaaagagagtaaaagaagggaaagcccctgcttttaattaatccatccttcaaaagttgcgcgatagaacccttcgattatctctactttcttaaggtaatatgtaacaccattcttaacagttgtatttgggatatcccatctatgaaggtaatccattgtaaaagaatctctggtcgcttgtgtcgaaatttttgtttgagttgagtcgctatttgtatgaccagggctagatgcaaaagcaggggcagcggaaacgagtaaagcgagagacaaggcagaaccagttaaaactttttttaatttcattttgaacactcctttgttttttgatacacttgtattattacatacaatacaaaaagaaccaagggtttttttgttaatattttgtgagcgtgaatgtagttaggggagtggatggcgataggagcgatgctttcattcactgttgcggcttatttcagaatattgataagtatatagagaaaaagagttgaatattgctggcttctggtgagctgcagcctttgagtcagtgtttgctttagctattccagcgcttttccaacggggaaggtgcgatatgaaatttaacactgaaacaattgtacaaaagtaaaatctttatttaaaatgttataaatgcgaattttcaatataggaggttatctgatggcagaaaagaaaaaagctttaatcattgtggatgtacaaaaagcctttgatgataaaaagtggggagaccgaaataacgtaaaggcggaagaaaatatcagcaaaatactgaaattatggagagaaaaaggatggacagtcatatacatacaacatatttctgataaacctggttctttattttatccaaaaaatgagggggttgctataaaggaaatcgttaaacctatggaaaaagaagtcattataaccaaaaaagtaaacagcagctttattgggactaatctagaagagcttttaaaagcaaatgatataacaactgtcgtaatcactggcttgactacgccgcactgtgtttcaacaaccacaaggatgagcggtaatttaggatttgatacatacctgatttcagatgcaacagcagccttcggaatgagagatcaaaatgatacatattatgatgcagagactattcacaatatatctctggcaacattgcatgatgaatttgccacaatattaacgactgatcaattaatcaatgattttataaaaacaaactgactaacattatggctaagggcggcggtagggataggcggctgaaaagcatattcaggcgcatacaaggacctctcgaaaaatacggggattaccgactcttttcatcgtcgcaatatcgattgaaaaagccatctgcttcagatgctttttttgtttcttgtaaaccggttttgatcggcggttaacggtctgattcggcgaataacaaaaggctttactaatcagcgaattattcaagattttttggcttatgctgggtctggtgacttttgatttcctcgaatatattggcttgatcatctttttgaggctgaggctctttgttaagacattttggatcgatcacatttttaaggtctttgatggttaaaggcttacagtcatcttttaattcgtaacctaattgtccattagcttataaattggcatatttaattgtgtttatgtttgaaatgccaagaagtcttaaacgcatttcgagttgatctgctgtcagtctcagcttctttaagttttctgagttggccgtcttctataacgaatttaggttttccggttaaaaaagattcaaccagtttacttttacttgaaaccattccatcaaaatcaaagcgctaaaaaggatagacgcagcgattaatgttttcaataaactggtttctaaaatggggtgaacgataatcgtaccgattgaaatcatcaccattgtctgtgcaatggtcatttgtgctatggattttctccctgaaattctcagtaaaatcattccgaatgcaattataattaattcttcccaagcaaatctcatgttatcaccctgggttgtgttttatcaaaaataaaagagcaagtaagaggttttatggggtacttgctcacgaagaattattgcccttacatttaattttattcattttaggtgtttttctgatcggggatgtcctgcgcccctcgtccaaaagaaggtttgataactaaagaggggaggaaaaacattccatggccttttgtttacgtcagcatatatcaagaatagagttaccttaacatgagctggggaactcaagcgtccatagaaatgttctgaaggatctggattgattcttcgtaaagagttgaggctcggcttttggatagacatgtgattcactaaagtgctgcaggatccgatcaaaaaacctatggcaggagagaattttagattatgtgtttttgcgtctaaaagcagaaaacagtacaactgataatgatcatcgggtgaaatgaaattacgcaactaggtgctatatgtaggatcaattataaaaggcagtgaaactagaaaaaggggcaaagcccccttcatattagtaacagtgctcatcattcccataccagattccgttccagaaagaaacttcttttagataccaattgttcatatcctccagaagttgcaaaagcaggagattccgatacaagtagagcaagagataattcagaatctgtcacaattttcaattttgacacttcttaggtacatgttagcaatcatttattctcttatcggcacggtaacatacggattatttttagttgttgcttagaacaaacattccgcgtcatgaaaaatcagcttttgtagacggctgtccaagtgccatcagcaccatggaaggtgatgttgtctaaataataggtgattccattccggtaaattgaagtaggataatcaggtccggaaccattaagtatgaacgtcgccaaagcagatacttccttcgttttactttctgcagaaggtgtatcagcaggacctgcggcaaaagcaggggcggcagaacagagtaaagcgagtgatagggctgagccggctaaagctttcttcattttcattgtaaacactccttttcttttttaatacaattgtattattacatattatgttaaataagtacatgcttatctttgttaattttttgtgaacaaacagataatctatttaaacgcagagatgaaataagtatgatgatgaagcaattatcatctataaatataagatcaggaagtggctgattttctcaaaaatcatctgctcttgcgaaatggggagttgcatgacatttacggaacgggcggtagccattatcaaacagattcctgaaggaaaagtgatgacgtatggtcaaattgccgatcttgcgggaagtccgcagggagcgaggcaggttgtgaggattcttcactccatgagtaaaaagcatcgtcttccttggcacagggtcatcaatgcaaagggcgaaatcggattgagagacgaagagatgttttctgtacagaagctgtctcttgaagctgagggggtagcggtcacgtcagacggacggatcgatctcaatttatacctatatgatccgaatatgtaaaaaaacctgccgtatatcggcaggtttttcagttatatgctttgagccggccagaaaggttttgccggatataaggccattcctcccgaaggatggagtagtaggcggtatctctgagaccgccgtcgacagccggaatgtgtgcgcggcggatcccttcaaattgggctccgatccgcaaaatcgcagtccgtgagcgctggttgcgaacgtcggttttcagcgtcaccctgacagcttgccacacgtcaaacgcatgagtcagcatcagaagtttacattccgtattgacaccagtccgctgcacggcagaggcataccatgtgctgccaatctcacacacttccggagctgcgtccgccggccgcgtaaacacttccgcaaccataaaccgcgtgcttccgacgattcggtctgtttcaagactccgtactgcaaaaggcaatgcaagtcctttttcataatcggaaagcgcacgctcaatataacgctttgtttcttcgattccgtcagggacatgggtgtaagcataagtcgtcctattttctgaagctgcttcgcaaagtgcctgagagtgatcaatcgtcagcagctctaactgaacgagtgaccctttaagaatgacaggtgtcagcatcccaatcacaaccttttttatgaatggatcaagtatagccgaacggtttcttattcaaaagggccaatttcctattaaaatggcatgtcagtgaaatcctcgattcaaacttatgcatacattcaggaaaaaagcggaaacctttatgtaaagaggtgatgggcatggcatatgtgttatctgtcggaacgagcattccgaagtatcatgtctcgcaagaaacggcggcggattttgcgagagggatgtttgccgattcatttaaggatattgatcggctgttaaaagcctttcaaaacggcgaaattgaatcaaggcagtttgtccggccgattgaatggtataaaacggcacggggtttttcagaaaaaaaccggctgtatacggaagaaaccgtcaagcacagtgcggatgcggcacttgattgtttaacaaacccggattgtttaacaaatccctttccatatgaaaaagtggatgcgatcttttttatttccagcaccgggctttcgacacccagcattgaagcgaaagtgatgaatcagcttccgttttctgcgaaaacaaaacggataccgatctggggcttaggatgcgcgggcggagcggccggcctgtccagggcgtacgaatactgccgcgcgtatcctgaagcatacgtgcttgtcatcgcggctgaactctgcagcttaacgtttcagccgaacgacaagtcaaaaagcaacttaatcggaacttccctgtttgcggacgggattgccgcagtactaatgggaggagaaaaggcgaaccgaaacgacgtcaaacagccgcttcttccgcggatattcgccactcaatcggtgatgatgccggatgcggaagatgtgatgggctgggaattcaccgacagcggttttcaagtcattttttcaagagacattcctaccctggtttcacagtggctgaaggacaatgttgatgaatttttatttgaatatggtgtcagtactcacgacattaaaacctttcttgcccatccaggcgggaaaaaggtcattgacgcctatttaacgagtctttcaatgggcaccgggcagcttgcggcatctcggaaggtgctgcaaaaacacgggaacatgtcttccgcaactatttttcatgtgataaaagaacagttgctcaacggacggcagaaagaaaacgaaaaagggctgatcggcgctctcgggccgggattttcgtctgagcttttgctgttcagctgggaaaagggggcttcttaatgttttggctgtttatcatgctggttgcggcccagcggattgcggagatgatcgtggcccggcgcaatgagcaaaaggtgaaaaagcaaggcgcagtcgaatacggagaaggacattatccctttctcgtcctgatgcacgtgctctttttcgtctctcttacagctgaggtggcggcgtttcaaaaaacgctttctccaaggtgggccgccattatatgtattattttatttgtacaggggatcaggtattgggctctattatcattagggcggtattggaatacgaaaatccttgtcgtgccggatgcggagcttgtcagaaaggggccgtacaggtggatgaagcacccgaactacgcggtcgtcatcttagaatttatttttctgccgctgttatacggagcgtattggacactgtttctcttttcgattctcaatgcctgcatgctcactgtgaggattcgcgccgaagagaaagcgctagaagaaaacaccgcaaaatagagattgaaaatcattctcactcatgataagatgtaaatatgaaaatgattctcattcaaggtggtgccgaaaatgacaatgttatttttatttgcagccgtttgtacatacagtgttttaattggtttcgtattgaaaaaagtttcgaataaatcgatgtcttcttaaacatctgcggtttttcctgccgcgggtgttttttctttatcagctgccgatatcggcggcttttttgcgtttcctgaagaaaagtgagccattcttgtgtaaaatgggggagaggtttttttcagagctttctaaaaatgaaaaacgtcatttgatgcgacagacacaaaggggtaaagacacatgacagaagaagaacgccataacagggagattttcagcagaacgggtgccttatacgcacaatttttggatcatcaggatgaaaaacgggccgatcagctcgcggccattatgaaaaaagcggctgatgaagaggtttatatcgcgtttaccgggcattattcggccggaaagtcctctttattaaacacattgctcggtgaagacatactgccgacaagcccgattcccacaagcgccaacctcgttgtcatccggcacggtgaagataaagtcgtgcttcatacgacggacggggcttatgcagagatcaaaggaagttacgataaagaacaagtgcagcaattctgtaaagacggtgagcaaattgaaacggtggaagtctatgccggctttaaggagtcagagccttatgcggcctacattgacacaccgggaattgattcgacggacgaagcgcattttttatctgccgcttcagttctccatcaggctgacgctttattttacgtcgttcattataatcacgtccattcagaagaaaatatgctgtttctcagctccatcaaagaccgtattccgaatttgtttctgatcgtcaaccaaattgacagacatgatgaaactgaaacgaagtttgaagagtaccgcaggcaggtggaagacatgcttgaaggcgcgggaataccgaaagaatcgcttttctttacgtctgtcactgagcctgaccatcctttaaacggcatggaacagctgaaaaaacatctgcagaagctgaaacagcaggcaaaaacaaatttatggtccttaacggagagaaaagtcgcacacttagtcaaagagcatacagagatgctcgtaaaagaagataaaaacggcagcggagagcagtttgacaaacaagaagcacttgtccgttctgttgaagatgagcttaaaaaagccgttcaacaggctgaaacagcagagaaagacatcagaaaagacgtgcagaacatattgcaaaacgctaatctgacaccctttgagatgagggtgcttgcatctgcttatattgaatcacagcagccatcatttaaaaccggattattcttttcaaaagcgaaaacagcttcggaaaaagaaagaaggcatgctgaattttttgccgatattaaaaaaagaacggaaggggaagcggattggcatattatcgacacatttacgaaagcggccaagcggtatgaagcggattcggacgaactgatcaagaaaatccaggcgtaccgcacaccgctttctgatgatatcaccgctcaggcccttaagcagggagcggccttttcatctgaatacgtattaacttatacgaaagacctcgctgaaatgatcagaagggaagccaaaagacagacagcggaactcattgaggagctgaccgcttatgttcagacaaaaaacggaccgctcattgagaacttgaaaaaccggctcgaaaaagaaaagaaaataagggatgagctcgcgcaatcggcaaaagaagaacgcaatgccttggaaaaagcagcccgcgtccgcgctttgtgggaagaagaattgacctgtgatacgggaagcggcgactggtatacgcgaaaaaaacgccttgcaaaagcgcccgtccaaaagaaaccaaaagaggctgtacagcatgaagtaagcaagcccgaaaaaaatgcgatgaaggaacttcctataaaagagcagactgatcggttctatgagcttgccgggattcttgaatcctcgagcatattaggaaaacaggcagaagcctttcgaagcaggattgagcggcttgaaaaccgccagtttaccttggcgttattcggcggattcagttccggtaaatcatcatttgcaaatgcgcttgtcggtgaatacgtgctgccatcatcaccgacgcccacaacggctacgatcaacaaaataacgaaaccgcaagacggcaaaccgcataaatctgcggagatcgtttttaaaacggaggaggagctggacgctgaaatgcttcagctgactgagctgaaagacgctgatgtaaaggggcgttcactgaaagagagatggaattatgccattaaaaagggaaaaattccggatgaactcatcccggtgattcagacgatgctgcaggcgtttgatacgtacgaagaacagatccgtcaaaggctgacactgacggtgccggttgaagatttaaaaccgtacgcagccgaagaaaaaacggcctgctgcgtaaaagaagtcaccgtgtattatgattcgcctctcacgcaaaaaggcatcaccattgttgatacgccgggagcaagcagtataaacaagcgccatacggaacttgcctttcaatatataaaagatgctgacgcgttcttttatatgacgtactatcagcattctttttcaaaaggagacaggtcttttctgaagaaactcggcctcgtcaaagaatcattcggcatggataaaatgttttttgtcattaacgccgccgatctggccaaaaccgaaagcgagctggaaaccgtcaaagactatgtccgctcagaactctcaaaagagggaattaaccggccgaaattatatcatgtttcaagtaaagaagagcttgcgggtaaaaaagaagctttttataacaggttctctgatgtaagaaccgggcttgagcactttattgaggaagatgtaatgagggccagctgcgcccagctgaaaacagaggcgggcaaattgtgcgatatggtggaacagcttcacgaatctcttcaccagtcggcagaagaaaaagagaaaaagaaacagcgtctggagtcttcctatgaaaaagctctcgctgacatttcaaagcgccgtacgtctgaggtcatcattcgaaaagtgatgaaagatacgaaagaacagctctatcacattaaacatcgcctgacgttttatgcgaatgatatgctgaaaaccgccttccatccgggtcttcaaaacggtgattggaaacaaaatatatcagcggcgctgaatgaagcgctcaaggaattccgttttgaatatattcaagagctgaaaacgctcgatatccggatgaccggttttattgagcgtcatatgactgaggaatggatggaaaactgtcagaagaagcttatggaagacggaaatttctccatttatgtgagcggtgaaaacgaatttgccgttcagctgaaagaggtcgctccggtcattgacgtctcggcattctcacatcacgtaaaggaagttaaatcaccgaagcagttttttgaacagaacggaaaagcagcgtttgtagaagggctcaggctcagcctgcaaaaagtgacagaaaagtggcttgagcaggagaaagaaagcctttcagagcgatatgctgagcaggtgcgccgtctgcaagaagacatggcggataaaagcctgtcccagatccgcgagcagcgggacacttatttacaaggtcttgcggaaaatacgagtgcaagggaaattgaacacctttacgaagccgaaaaagcatggaaaaagaaagatgaaatgctgaaaatttaaaaatccggttggcgggcagataacagtcatggtagactaaaatgaaaaaaagcgagatgaaaccttttatgtcagaagtccataaagcaatttcagcacattccgcaaaacagcatcagcacgtcaaaacatttgtacagcttgattatgagcgtgaacaggccattgaagaagcaattgtaaaatgcagacagaataaaccgttcacgacagatgccatcaatggcatcaccgcaaaaatgaaccagctggcgaaaaagggcatcgtgccgcaaagacgattcgtaagtgaagagatggtgaaagaattcgtcagcagacagtaatggatgaacctgccgcgtgtgtcatcagcgcttgctgtacatactatccgtatcttctctaaagggggatatgaccatgggcagaacaaaactgggaaacagaaatgctcagcagaataacaatgccaaaaagaaaaacggcttcggacagaaatttgattcttatgccggccgtgaagctgaaaagctgatggcaagcaataaaagacacggtgaataacgtgacggcagcatcttccaaatggggggatgctgtttttttaccgccttctttggtaaaataggaacattgaataaaaaggagtttcgatatatgaataataaattactgctcgttgacggcatggcgcttttgttccgctcgtttttcgcgacggccgttcatcgcaattttatgataaatgaaaacggaattcccacaaacggcgtcaacggttttttaaagcatcttattacggcggttgatacgtttcagcccacacatgtcgtctgctgctgggatatgggaagcaaaacgtaccgcaatgatttgtttcaagattataaggccaacagaagtgaaccgccgctagagctgattccgcaatttgatctagcgaaagaagcagcgcgagagctcggttttttaaacatcggcataaaaggctatgaggcggatgactgtatcggtacgctttctgccctattttccggggaagcggaaattacgattgtaacgggtgataaagatctgcttcaattgctgaatcatcaagttcgagtagcgctgctgcaaaagggtatcggcaattataaggtatatacagatgagatattcagagaagaaacgggagttccgccaaaagcgctgattgacattaaggcgctgatgggagacacgagcgataactatcccggcgttaaagggatcggggaaaaaacggcgtacaagctgatccgtgaatatcaaaacatagaccggttattagaaagcctcgctctcttgccgaagggccagcaaacgaaaattcagcaaagcttgaaagaattggagctgtcaaggcagcttgctgaaatacattgcgaggtgccgttagtctgtacgcttgaagaagcgcttttttcattaaagatggaagaggctgcattaatgctgagacgtcatcagataaaaggaattgaaaggatgctcgaaaagctgaacgccagagagataagctgatccctctagcgttttgtattgcttttttttgcgttgttttcaagggctgatttcgggtctttatgcgcatttccttccatatttccctgaggattcacgcccccggtcagctggcctttattttcttttctcatagctgttcacctcatttgtaggatgaacagtgagacgcaatttcattccggttatttattcagccgaatcgctttttttgcaagctgatcggctgtttggttttgtctgccgggaatccacttaatgaaaaacaatggaaatccggactttaagcggatgatttcgtcaacaaacggctggaaagccttgtttttaaccgcttcaagatctgcggcccgctccacgatatccgaatccgtccggaatgacacggactcatatccgcgggcggcacacagcttcattccttcaattaaagcgagaaattcagcttcctgatttgattggtcgccgatcggaattgagaaagattctgttttcccgtcatgtttaataaaaataccgataccggacgggcccgggtttccggcgcttgcaccgtctacataaatttcagcgggcatcatccgtcactctccattcggtgtcattcgttttgccgcatacgcataagggacagaaatgagtgataccgcaaatttaatcaggtaagttgaaatgaagatgctgaaccatactcccgcggaataaacgccgataaaggccacggcagtgaagataaatgtatccagcagctggctgagcgccgtgcttccgctgtttctgagccagagaagcctgtctgaaggaaagattctccgaatggctgaatatacataaacatctatcgtttggctgaaaataaaagccaagaggcttccgagcgcaacacgcggcagaaaaccgaaaatcgtctcaagggcaggctgtgcgatatctgatgcagccggtttatataaaagagccccctgcatggcgcatgtcaaagcgagtagagtggaaaacccgagccagacggctttgcgcgcttccctgggaccgtatttttcattcagcacatccgttgcgaagaaaacggtgccgtacatgatatttcccagtgtcgccgtaagcccgaacagctcgactgttttgacaacctgcaagttggcgcacaccgtggcgaaaccgatccatacgaataggcccgttttgccaaatcctttataaaacagaagaacaatgataaaatgaatgaccgcaaataagatccataacacatcgttaaacaaaacctgctgacttcctttcaatttgagaatggtttgattatagcacacgcccgtcaactaatgaatggtaaggtgatttcaatgaatcttaagccgtatatcgaaatagaagcaaaaggaacaggccctgtcgcgtttttttccgaagattggctgaccgttccgaaagcgcgcatgcttgcaagagaagtcagccgctttccttatataaaagacatttattttgaggatgaaaaaggcgcgagctggacgcttaaagaattagaaaagcttactgaagagcttgcgcacgaacctgacgacattacagtgtatttcgacggcggctttgacaaaacaagcggacgcgccggactcggaattgtcgtgtattattctctcggcggcaagcgataccgcatacggaaaaacaaaagcttaacgcttcagacgaacaatgaggcggaatatgccgctttatacgaagcgcttaaggaagtgcaggaacttggcgcaagcagaaattcaatcacgataagaggggattccctcgtcgttttgcatcagcttgacggcagctggccgtgttatgatgaaacgcaaaacgaatggctggataaaattgaagcgctgctcgaatccttaaagctgacaccgacatatgaagccgtaagccgaaaggaaaatcaagaagcggatgaccttgccagaaaaattctctcggaccggcagattgaaagccgcataacattagaaggtaacggagatgactgatattggataaaaaaagcatttataaagaattgacagagcttcaggatgaatattgcaaagactgtttcgtaaaaaagcatttccgcaaagagtttggaaaaacgcacgctcattctttctgcatcaaccaatgcacagtgggggagaagctgaaagcctacggcaaggtgctgacaaatcaataaaaaataaaaccgcagcttctgcggttttatttttcgaattcatcgagctgatgctggcaatcgtcgagaagcattcgctgcttttgcagaaaaccctggtcgagagcttgcagttcactggattgtgacatcgttctggcatcctgaatcgcttggtaagcagattccaccaaagttgaattttggccccgggtagccgctcccgttgttttctgggccgtttccaccgctaattcaagctggcgtttatccgtcagtccgtttggaaaaaattcagagtccattaaaaaacacctccgcaaatagtttggagattttttttagaaatatgtacggaaaatagaaaaaaatatagaaaataagccgatataactattgaacctgattaattagggcttatttactattattcagggtatcttgggagagaagggaaaaaccagccgtgaatgataaagatttaaaaacaatccttcagcagacatttaaagaaatatacggtgatttgggaagtttagcggaaatggcaaaaaaaggaatgccgtcaatggagaaacaaattgaagaaatcgagcagcgctgcaagcagaatcttgttgcaattgagattcagacggcaatcaaataggagaggcatacgcctctcctctatttgtcatctgatcaacatgtattgagtttagagttttacaacattagaagcttgaggtccacgattaccttcgacaatttcaaaagaaacttcttgtccttcttctaatgatttgtatccttctccttcgatagcagtgaagtgaacaaatacgtcgtctccgccttcaacttcgatgaagccgaatcctttttcgttattgaaccattttactttaccgttttgcatattgcttaattcctcctagtactgtagcaccttcgtgctaaaaaaaattttgtcatcatccaaccgtacgtatgtaaacgttgttaaatgatggttcaactatacaccatatgggagcggacgtcaagcagccgctccctattttttatctttatttttccagtcacaaagcttaaccggaaaaaaacaaaaagcacacgaatcgttcgtgtgcttttcttttacgataatgccatatctgccttcccggccatcatttcagattcttttataatgtcctgcaaaatgacttcagaagagttggggaggtgaaggcttttaatattgtccttcatccggttcagcttctcctcatccgcaagaagggaggtgaccgactctaaaatttcttcgtggcggttgaccacgacagccgcaccgcgatcttcaaagaaaatggcgttttctttttcctgtccgggaaccggtttgtacaaaataacgggtactccgatcgccgttgcttccgtcagtgtgatgccgcccggtttcgtgatcatgcagtctgtaatacggaacagctcgtcaattctttctacatagcccagaactttcagccggtcggcattgtcaccttccaagctgctgagggattctttcagcgagctgtttttgccgcataccaccacaacctgcacctgatcgtcatgaacgagattttcgcacagttcttttacgtttttcagcacaccatgcgctcccgccataataagaagaacttttttgtcgggagagagattgtattttttataaatcggctctttcggcatcgattcctcgaattgaggcctgatgggaatgcccgtgatctttacgttgttcgggtgagtgccgatttcaatcagtttttccttcacgtaatctgtggcgacataatatttatcaacattttcatgaacccagattttgtgaaggcagaaatcggtcataacgttgaacgtcgggatcacttttccggttctccgtctgtattccggtacgacaatcatcggaaatgtattgataataatgtccggcttatgctcttcgacgagctggcctaaacgtttatttcccattttaaaataaatattgaatttgcgtttattatagattttgtcaactccgtaataaaacaaacgataaaactgtttcccgattgagaagctttttaaataaaggtattgagtaacctctgaaacaatcggatttgactcttgatacaaattggaaaccgtcacatctaagccgagacgcagacactgttcgtagagcgttttggccacttgaacatgcccgtttccgtaatttgcagtcaaaattaatacttttttattggtattcaagtaaattcacctcaatgtaatcaacaacaagcaagcttcatgcatcgtaaggagttattgtctatagataaacataacacaagtgcatcattttataataagcgcggcaacatatttaaactaaatttaattgatatgttccattattttaaagttttgttatacgcatactgaatcaagagtattttatcatatttttgtcaccgtatcactcaaaacaaaaattaatcccattcatacggggtttcctgatatacgtaataattcagccaattcataaacaataacgttgcatgagctttccagcggttaacaggttctttcccgccgggcgcaaaatagtgcttaggagcttctacgtttgaaagatttctctctatgtctctctcatactcctgaagtagcgtatcggtatcatattccggatgacccgttaagaaaatctgtttttcgtcttttgaaacgattaaacagacccccgcttcctctgaaacgctgagcacatccagatccgaagccgattgcagctgctccgtattaatatctgtatgccgtgagtggggcacatagtatagctcgtcaaatcctcttaccaatctctcatgttttttaagaacggtatgctcaaacacaccgaagatttttttcggcagctccactttctcaatgccgtaatgatagtataaaccggcttgagcgccccagcagatatggagggttgaagtgacattcgttttgctccattccatgatttccttcaattcttcccagtaagaaacatcttcaaacggcaggtgctcaatcggagccccggtaataatcattccgtcaaaccgtttgtggcgaatgctggaaaaatccgtataaaactcatccagatgctgccttgccgtattttttggagtatgtgtgctcggaattaagaacgtaaagtgaacttgtaaaggtgaattcccaagcatcctgaggagctgggtttccgtttggatttttttcggcatcagatttaaaatcacgatcttctgcggccggatatcctgatgaaaagcccggctttcatccattacaaagatgtgttcactttcaagcacctgcttagcgggcaggtgatttggtatattaataggcaacatgccacctccgttattccccgttaattttcttcattatagaaatttttaagccatttttcaatccatcccggcgtaataaaccgcatttaacgcataatgacggggataaaagcggcaaataggcataaattcggagcggctctttattatgacgggtaaagagccgtttggttcctcgaaaaaaacgttttccgttaagtggaaggaaaaagcggttgccgtttgttttgcagtgtaaaacaggtaaaataaatgaagaatgtaaaaaggagggccgcagatgacaatttacgatataaacgtacggaccataacaggcgaagacatgacgctatcggcttacagaggcaaggtgatgatcattgtgaatacagcaagcaaatgcgggttcacatcccagctcaagcagcttcaggagctctatgatacatatcgggaggaaggtcttgaaatattgggatttccctgcaaccaattcatgaaccaagaacctggaaacgaagcggaaattcaagatttctgtgtgaaaaactacggagtcacattcccgatgtttgcgaaagttgatgtcaatggagcagacgctcatcctctcttcacatatctgacggaacaggcgaaggggatgctcggcacaaaagcggtcaaatggaatttcactaagtttatcgtggaccgaaacggtgaagtcaccgggcgtttttcaccgaacgtcaacccaaaagagcttgaagatacggtgcagaggcttttggcccgataagaggtgatacgatgaacgaaaaagagcagctggaaagcgtcaggaattgggtcagagaaaagcttatcaatgaacgaacgggccatgactggcttcatatttcccgggtcgcaaaactttctgtgtacattgcaaaagaagaaggcgccgacttatttatcactgagacggccgcgctggttcatgatctgattgacgccaagctcgaaaaaagcgaaaggctgacggcaggcgaagtgacagaacggctggctgctttcaacattgcggatggctccattcaggagatcgcggatattatcacgagaatgtcattcagacacagggaactgctgataaagcggccgctttcattggaggggaaagttgttcaggatgcagacatgcttgatgcgatcggcgcagcgggcatcggcagggcttttatgtttgccggggcgaagggtcacccgatgtacggaactcaaacaagtgtgctggcccatatagaggataaattaatcaagcttaaaggcttaatgaatacaaaagcgggggccggtttagcagaggagcggcatcaatttcttttgcagttcgccgcccgtatccaaaaagaggccggcatttgcaaaagctaagcggcgcaatagaacgcttgtgccgactatgttagaataagtgtcagattgcgcataggaggaccgatatgaagattaaatcaatagaaccgacgccgagtccgaacacgatgaaagtgattttgactgaagagcttccggcagggaaaagcaacaattacaagcccggtcaggcaggtgatgctccggctgtcgtacgtgatattttaaacatcgaaggagtaaagggcgtttatcacgttgccgatttcctggctgtggagagaaacgcccgttttgactggaaggaaattctgcctcaggtccgttccgccttcggaatggaacatacggagcagtctgagagccgttctgaacaggaatcgttcggtgaagtgaaggttttcgtacaaatgttcagcggaatcccgatgcaggtcaaattgacggacggcgaacgtgaagagcgcttcggccttccggaacgtttccaagaagccatcttaaagctgcgttccgaagcttcaaatgttgtatttgagcgggcttggaaagaacaaggcgtgcgcttcggggattttaccgaaatcggacacgatgtcacagaagagcttcaggccgcctacagtgatgagcggctcaaacgcctgacagaagcagccgcacagcaaaagggtgaggccaaacctgcagtgcagcggaaagcttataaagtgactttggacatgctcgatgatgaagactggaaacagcgctatgcccatcttgagcaaatggatccggatgaagacgatttaccagtattggaaaaggcgctgtatgatccgaagacttcgatcagaagacaagccgtcgtttatttgggaatgatcgaaaagccgtctgtgcttccgctgttatacaaagcgcttgaagacaaaacggtgacggtcagaaggacggcgggtgactgtctgtcggatcttggcgatgcgagcgccatcccggccatgacgaaatcgctcagtgactcaagcaagctcgtgcgctggcgcgcggccatgtttttatatgaggtcggcgatgaaagcgcgctggaagcattaaaagcggcggaagacgatccggaattcgaagtcagcctgcaagtcaaaatggcgattgaacggattgagcacggagaagaggcgaaaggttcagtctggaaacagatgactgaaagcagaaaaaaagaacagttataacaaaaaggtgcgcccatgcaccttttttatttgaattcactttttataaaaattatttagaatattgttgaaaaatgattcaaaactctatatagtaagtacaatattaattgttggagggtttttatcgaaatacagaaagaatagaaaagcgagacagggcaaagacactgtaaaatttgcagaacgcgccctagaataaactgaaaattttaaaaatagtgcacagtctaaaaacagtagggggatcaccatggcagaattacgcagcaacatgatcacacagggaattgacagagcgccgcaccgcagccttcttcgcgctgccggcgtaaaagaagaggacttcggtaagccgtttatcgcggtctgtaattcatacatcgatatcgttcccgggcatgttcacctgcaggaatttggaaaaatcgtaaaagaagcaatcagggaagcgggcggtgtgccttttgaatttaacacgatcggagtagatgacggaatcgcaatggggcatatcggcatgagatattcgctgccgagccgcgaaatcattgccgattcagttgaaacggtcgtctcggcgcactggtttgacggaatggtctgcattccgaactgcgacaaaattacgccgggaatgctgatggcggctatgcggattaatattccgaccatttttgtcagcggggggccgatggcagccggccgtacaagcgacggccgcaaaatttcgctttcttcagtatttgaaggcgtcggcgcatatcaagccgggaaaatcggtgaaagcgacctgcaggagctggaacagttcggctgcccgacgtgcggatcttgttcgggcatgtttacggcaaactccatgaactgtctgtctgaagcgctcggtctggcgcttccgggcaacggaacaattcttgcaacttcaccggaaagaagagagtttgtgagaaaatcagcggcccaattgatggagaccatcaaaaaagacattaagccgcgcgatatcgtcaccgaaaaagcgattgacaacgcatttgcgttagacatggctctcggcggctcaaccaacacagtgctacatacgcttgcgcttgccaatgaagctggggttgagtactctttagaacgcattaacgaagtggctgaacgagtgcctcacttatcgaaattggcgccggcctcggacgtcttcattgaagatctgcacgaagcgggcggagtctcggcggcccttaatgaattagcgaaaaaagaaggggcgcttcatcttgacgcgctgactgtaacaggccgcacactcggagaaacaattgcgggtcatgaagtaaaggattatgacgtgattcatccgcttgacaatccgtttaccgaaaaaggcggtttggccgtcctgtttgggaatctggctccggacggcgccattatcaaaacaggcggcgtacaggacgggattacaagacatgaaggtcccgctgtcgtctttgattcccaggatgccgcgcttgaaggcattataaaccgcaaagtaaaagaaggagatgttgtcattatccgttatgaagggccaaagggcggcccgggcatgccggagatgctcgctccgacgtctcagattgtcggaatggggcttggcccgaaagtggcgcttattacagacggccgtttttcaggagcgtcccggggcctttcaatcgggcacgtatcgcctgaagcggctgaaggcggcccgctcgcattcgtagaaaacggcgaccatgtcatcgttgacatagaaaaacggattttggacgtacaagtgcctgaagaagaatgggaaaaacgcaaggccgaatggataggcttcgagccgaaagtaaaaacaggatatctggcccggtattccaaactcgtaacaagcgccaatacgggcggaatcatgaaaatataaaacagaggcctgaacaattgaattccggccccctctatagtatccttgacttcatataaggattttagagggggcttttttatgtcaatggcttatgaagaatatatgcgccagctggtcgtgccgatgcgccgtgagctgacgggtgcgggttttcaggaattaacgactgctgaagaagtagaaagctttatggaacaggcagagggcacgacattggtcgttgtcaactccgtgtgcggctgtgcagcaggtcttgcccgtccggctgcgactcaggctgttttacagcatgaaaaagcgcctgatcatacggttaccgtatttgccggtcaagataaagacgcaactgcaaaaatgcgtgaatattttacggggcaggaaccttcctcgccttcaatggcgctgttaaaagggaaagaggtcgttcattttattccccgccacgaaatcgaagggcatgacatggaggaaattatgaaaaatctgacggatgccttcgatgcgcactgctgaaatgcccgaattccgggcattttctttttggagaaaaagatgatcacaacgagttacagaccaagcgaatatacgatacacacagcgcagtcgctcagtgtcaagctgggtgacacttactgcagccgcaataaacagcccattgaaaaaatgctggaacgagcggctagcgatcttttagtcatcggaaaggaacggttcgaactttacacgaagcaaggggagaagttcttttttcacccgaatacagcgatgttccgcgcaaagcggtttttgagaggggaagccgagccgttgttaaaagcagccggattacgcgaaggggattcctttttagattgtacgctcggcctggcatccgatgcgattttggcaagcctggcagtcggaaaaagcggacaagtcatcggcctggagaaaaacaagcttgtctcattgcttgttgaaacaggacttcaaacgtgggaaaccggaatggaggagctccaaaccgccatgaaacgcattcatgtcaaacatgccgactgcgccgattatttgcgggagcttcctgattcatcggtagatgtcatttattttgacccgatgtttcacgaacctgttgaaacgtcagacggcattgcaccgctccgcgcgctggcagaagagggttttaacgaagagtgcatcacgcaagccgtccgggcggcgaaaaaatgcgtagtgcttaaagaccattggaaaagcccgcggtttgaacgatacggcttcaaggtgctgaaaagaaagacggcgcttttccacttcggtgtcatccatgtaagctcatgatatcatgggcttctttttcgttaatcagtgatttccataacgacaaaatatagcagcgtgagaagtgatactgtcgcaaataaagcgttaatcatctcatcccctcctttttctccttcttattgtaagcggtttatccgatcggtcacagttaccaatttcccatattgcatgataatacgctgccggacatgacgccgcgctttcatctatgctaaaataaaggaaaagaggacaataaaacagaggggaacaatctgtcatgaaattgtggatgaaaaagacccttgtggttctgtttaccattgtaacgttcggactcgtgtctcctccggctgctttgatgacagacaagccttcaggacagtcgagcagtcttgagcagaatgattacaccgctttttatgatgaacacaccctgccgggagaagagaaggcagggcgggagcctgaattactgtttcaatcgtatcagcagcagcttctcggtgatgctgaaaatcaatcatttttaaaattcggctgcaaaatttctccggtcattgaagatgattacagaagtgaaattctgccgaaaattgaagatgtgatcacaggacatttagccaagtttcaagatgatgaagcgtatcaggatgtggttatttccagcaaaccgtcggccggaaaaactgaaaaaatttttcatgtgtataacaggctgacgggtgaagatcttttaaggttccacgtccgccgggatcatcctccgcaagacggctactggtttaattttcattaccataccgctgaagacggatttcagtcacatcatgagctcggcagcatttactgggaccgcaatacgccgcctgactggatgagcgtgtaatagcgagaagaaataaaaaaatcatttctgagaaattttgcagaaatgattttttattgtgttacactactaaaagactactttaaaaggatgaaaaaaaatgaaacaatataaagatttgtgccgtcatgtgttagaaaacggagaaaaaaaaggagaccgtacgggaacgggtacgatcagcacgttcggctaccaaatgcggtttaaccttcaggaaggtttcccgatgcttacgacgaaaaagctccattttaaatccatcgcgcatgagctgctttggtttttaaaaggagatacgaatgtccgctaccttcaggataacggagtccgcatctggaacgaatgggcggatgaaaacggagagctcggaccggtttacggttctcaatggcgttcatggcgcggagcggacggcgagaccatcgatcaaatctcccggctgattcatgacatcaagacaaacccgaattccagacgtttaatcgtcagcgcctggaatgtcggcgaaattgatcatatggcgcttccgccttgccactgcctgtttcagttttatgtcgcggacggaaaactgtcgtgtcagctttatcagcgctcagcggatgtctttctcggcgtgccgtttaatattgcgtcttatgcgcttttaacaatgatgatcgcgcatgtgacggggcttgaaccgggtgagtttgttcatacattcggagacgtccacatttaccaaaaccatgtggagcaggtgaatttgcagctgacaagggatgtccgtccgctgccgaaactgcggtttgcgcgaaatgttgattctatttttgattttacgtttgaagactttatcattgaggattatgacccgcatccgcacataaaaggagctgtcagcgtatgatttcgtttatttttgcgatggatgaaaaccggctgatcgggaaagataacgatctgccttggcaccttcccgatgatctcgcatatttcaaaaaagtgacgacgggccacaccattgtaatggggcggaaaacgtttgaatcaatcggacgcccgcttccgaaccggcgtaacatcgttgtaacctcacgggacgaatctttattcccgggctgtattaccgccgactcggctgaggaagtgctcaagctgatcccggcggatgaagaatgctttgtgatcggcggcgcccagctgtacagtgcgctctttccttatgcggacagactctacatgacaaaaattcaccatgtctttgaaggagaccgtttttttccggaatttaatgaagctgaatgggaattgacatcccgcaaacagggagtaaaagatgaaaaaaacccttacgattatgagtaccttgtatacgagaaagtttaagcagggggacaagaattgattcgttacggctgccttgtgatgtacgttgtatttatgttcatgaaaaatattcaggaatatatcaatcaaaaagagcttgacccgcggctttcttttcaaaaacagatgaggctggtgtatgagcggccgaaagcctttatgagaggctgcattgacgtgtcgggatcggcaatcggcattcatcatgatcagccgataccggacggccccgtattgtatgtgcatcccagattgcgcccggctgatcttctgctgcttgcgggacatcttgaagagccggctggttttatcgctggcgagaaagctttccggatgccgtttctcggaaattggctgcggctgatgggtgtcatttgtggcggagacagccgggatgcagtgcttcatgaggcggaagtccgtctgcaaaaagggcaaagtctgattctgtccgaagacggcaaaatcaatccggaggaactggcccttcgtttcgacctcccgattgtgcctgtcagcacttcgggaacagaccggctgctgcggggcagattactgaaacggctgaaaccggctgacattgaattacatataaagcccgcttattttccggccggtcagaaacggctccgtgcataaaaaaagcacagtctctatagagaggctgtgctttttatttcagataaaggggactttgacgcaataaaataaaatacagaaaaacatcgaggcgctgccgcctaaaacaaaactgtgccaaatggcgtgatgatacggaacctttctccaaatataaaatattgtgccggcggaatacaataaaccgccgaaaagaagaaggccgaaaccggggcctgacagcgaagcgtacagcggtttaatggcgacgatgatcagccagcccatcattaaatagacaagcgttgaaaaaatgataaaccgcttcacgaaaaagattttaaacacgatgcctccgatggcaagcgaccaaacaataattaaaagggtcagaccgagcgcccctttaaggggtcctaataaaaatggcgtatatgttccggctattaatacgtatatcgcggaatgatccacaatctcaagaatgtctttcgtttttttatgctgaatgctgtgcaaaagagtcgagctgagatacagcagcagcattgaagcgccgaagattgaaaagctgacgatgtctgtcggcgagccgtatttcaccgcgaagataatgagaaaaataagcgccggaatcgacagcaatacaccgattccgtgtgtgacggcatttgcgatttcttcttttattgtgaacaatcaaatgtcctcctttttaaaggatttgtttttgcagtgactgcaaaaagctcaacccttctaatgtaatttttgttccagcgcgtcctcggccttttgtcacatagttcatcttttctaagtaatcaagcctgtttctgacctgctggggcgataatgtcattgtgctgttttcgcttaattcggatatgctccgtctgctggcgggttcgccttttgtatttaagtctttaattgattccaaaataaacaaaaactcttctttctccatcaatgtcagccgtttttcttttttcttagctgttttcgctttctggctgtttttgatatacagcgggacatcatcgggataaatcgtgctgccggatgctgccgcggccatatagtacgccgcattttgaagttctctgatgttgccgttaaaggtgtgccgctcaaacagcggataaacggacggatcgatatgaacatgctgccccgtggctgtcagcatatgctgcagaagaagcggtatatcgctttttcgttcagataaagcagggagcggaaggcataacacgtgaagcctgtaaaataaatcttggctgaacgtattttctgcgccggtatcaccaagatccgccgtgctgcttgcaatgatgcgggcggaaagcccggcatccagctcggaaagaaggcgggcctgtaccgagagcggcatgtctccgatttcatataagaataatgttccgcggcgggccctgtttaatgcgccttcagcgccgaacagttcatattcgagccgctcttcgctttggctgcagtgaacggtaataaatagttcgctgtttctgcgggatttatggtggatcgctctggccatttgtttttttccggttccgacttcacccgttatgaagactggcaaatcagataaagcaaattgcgaggccaatcgtttcgcttctgaaaaggtgtgatgttcgccggctagctgataaaaaggatcagtttgttcaattacactcatgaattggctccttttggttctaattggtttaagtataacacgtttgtgcgatcgaaaatatctttttctcttgtatcggttcatttaattttatttacaaaattaaaataattgtcttattatttgaatattcatgttataatggcatattaaatagggatttaaataagaaaggactctgtaaatgaaaccgttgcttaaagaagactctctcatccaggtaaaagacattttaaaagcgcaccaaaatgtaaaggacgttgtgatacatacgcctttgcagaggaatgacagactttctgagaggtatggctgcaacatctatttgaaaagggaagacctgcaggtggtcagatcatttaagctcagaggggcttataataaaatgaggcagctctcaaaagagcagactgaaaacggaattgtatgcgcaagtgcgggaaaccatgcgcagggggttgcgttttcatgcaaacacctcggcattcacggcaagatttttatgccgtcaaccacaccgagacagaaagtatcccaagtggaattgttcggaaaagaatttgttgaaatcatattgacgggtgacactttcgatgatgcgtataagagttctgcggaatgctgtgaaaaagaaaaccgtacgtttattcatccgtttgacgatcccgatgtcatggccggacagggaacggctgccatcgaaattttaaatgacattgacgttgaaccgcattttctatttgcaagcgtagggggaggaggactcctgtccgggctcggcacgtacatgaaaaacatatcgccggatacaaaaatcatagcggtagagccgaagggcgcagcctcctattttgaatcgaaaaaagccggacaagtggttgaacttgagaaaattgataaatttgtcgatggggcggccgtaaaaaaaatcggcgccgaaacctttcaaacgctcgaaaccgtcgtcgatgacgttgtgcttgtcccggaaggaaaagtatgcagcacgattctcgaattatataatcaatgcgccatcgtagcggagccggcgggggcattgtccgtgtcagcacttgatctgtacaaggaagagattaaagggaaaaacgtcatctgcatggtcagcggagggaataacgacatcggcagaatgcaggagatgaaggaacgctccatgatttatgaggggctgcagcattattttatcgttaatttcccgcaaagggcgggagcgcttcgcgaatacctagatgaagtgcttgggcctgatgatgacatcacccggtttgaatacacgaaaaaaaataacaaaagcagcggccccgcattggtcggcattgagcttaagcatcgggaagattacggcgcgctcattgcccggatgaatcaaaaaggatttcattacgtagaggtgaataaagatcaggatctgttccacctgttaatctgactttttttagaacggccgcgcaaaatgacagacacgctttctcagattgtatataataaaaagaaaacaatcgaaaaagaaggattgatatcttgttactcaaaagcctagagttcaaacgacaggacgggattcaggtaaaagtgacagaaataccggttgtcacggaaggtgaacattatttttttcaaattcatcagcaccttgagctttatttgagagaggtttttgcttcacaaagtgtgagaacagtgtattcattccgacaatatgtcaagcgccgtatgaagtggaaagattacgaggccgttttcaaccaagagattttaaaacataacgcataacggtgcatattccttagcgccttccttttgataagggagggtgcgggaatttttttatgatgaatgctgtaagcgttttatccatggggggaatggaaatgaaaaaaatgaaaatcttcgctgccgtcttttgtttgctgctcttgtgcgcctgcggggggaaaacgataaaagacccgctgaactatcagattgaaccgttttcatatcaaaaccaagatggaaaaacagtgtcactgaaaagcctgaaggggcatgtctggattgccgactttatgtttacaaattgtaatacggtctgtccgccgatgacggcccacatgaccgaactgcaaaaaaaactgaaggctgagaatctggacgtgcggattgtgtcgttcagtgtagatcctgaaaaggatacgccgaaacagctgaaagcatttgcttccaaatatccgctttcgcttcgcaactgggattttctgaccggttacagccaaaaggacattgaagattttgcgctgaacagctttaaatcaatcgtcaaaaagccggagggagaggatcaggtcatacataaaacctctttttatttagtcggacctgacgggaaggtgcttaaagattatgacggcgtgcagaaagttccgtatgatgacatcctctcagatgtcagagcggctgaggagctcaagtaaactggcagattagacattttcaaatctgaaaaaacatgttacactttccactagtagacggggaaggagcaaccagattgaagctgcgaatgttctcattgatcgccggactggccttgcttttatcagcttgttctgtccagcgcaccggttctgacgctgaagaaccgaaaacgaaagatcatattgtcatagctgcggtcggtgattcattgactgaaggagtaggagatcctgacggttcaggatacgtcggcagggcagcggagtctcttaagaaaaagggacacgtgaaaacggtagatattaaaaattatgcggtgcagggtgacaaaacgtcggacctgctggaaaagcttgataataaaaaagttcagaaatcattaaagagcgccgactatatcttttttaccatcggcggcaatgacttaatgaaggtgctccgccagaatatgatgcagctgacggttcagccgttccaaaaggaagagaaaccttttgaaaaacgattcaaggcgatcgtttcaaaaatccgcaaatataatgaaaacgcagagctggtgtatgtcagcatgtataatccattcacgtttacgctgcctgaattaaaagaaattaatggggttgtaacggattggaacaagattgccgcaaaagagctggaaaaagatccccacgccgctgcggtgaatgttgaagacttgttcagtcaaaaaagcggcagcagacggatttcaaaggatgatgattttcatccgaacgcaaaagggtatgcactcatcgccgatcgattgtacggcatcattgaaaaacaagggttaccagcagaatagggtgaaatgatgaaaaagtggaaatcgctgttttttgttcttctcgcactcaatgtgattgtcgccgcggtaattgtgacattattggttatgccgggagagcaggcgaaaatacaagatcagacaaaaagtgagtacggctttcatatcacgagctcgaaagaatctcttgccaggtttgtgaatgcgtacttaaaagagaaggcatcgaatcagcttgactacaaagtggacatcaataacgatgtgcacgtggcaggtaaaatcaaagcattctcaacctccattaacgcggtcgtcacatttgaaccgtccgtacaggagaacggagatgtgatgttgaaagtgacgaagttttccttaggcgaattaagcctgccgatcagctttgtgctgaattatatggacagcttttatgaactcccgtcatttgtgcacgttcattccggggataaaagcatcgagatccgtctgtcggaaatgcctttagacaacggcatgtatgtaaaagcggataaaatcaatctcgacacggatgaaattgaattttcctattatcatccgaaacaataagttttcataaaaaaaacacagatcctttcagggatttgtgttttttcgtgtcagcgttttttgtccagcttgctgaacagtttgattaacgttgcgagctcttcatcagagtagcagtcaaaccgtttaaaaaagtattctgtttttttctggttgaaatgatcgacaattttctccccggcttccgtaatatggattctgataattcgcctgtcctctttagaacggatgcgggtgatccattccttttctactaaagcgtcggtcactgcggtaatatggcttgcggagacctcaagaatgggggcgaattccgttacttttttaggcccttgttcactgagaatccgcaaaatggtgaattcgttcctggacagctctttatctagaatttcattaacttcatttctgatttgtttaaacacttttcgaagcaaagcttccatatcatacatcatttgtgtccttactttcaaatcatgaacctccaatatgtagtcagcgtggcattcgtttagcttcccctgaaagcagaattatttttattctgtttatacatgctataatataataataccacgtatgaacaaaggagggcacccgtatgtcagaaaaaaaagaaatcgccacatttgcaggcggctgtttttggtgcatggtgaagccgtttgacgaacagccggggattgaaaaggtggtgtccggctatacaggaggtcatactgagaatccgacttacgaagaagtgtgcagtgaaacgaccggacacagagaagccgttcaaatcacatttcaacctgacatttatccgtacgaaaagcttgtcgagctgttttggcagcagatcgacccgactgatgcaggcggccagtttgcagaccgcggaagttcatatcgggcggcgatatattaccataatgatgaacaaaaacaaatcgctgaagcctcaaaaaaacagcttgaagaaagcggcatatttaaaaagccgatcgtgacagacattttgaaggctgagcctttttatgaagcggaaggctatcatcagcacttttataagaaaaatcctgatcactacgggcgctaccgtgtaggttccggacgtcaaggctttctggatgagcattggagggacagataagatggcttttaataaagaagaaaaaatcaaatcattaaaccgcatgcaatatgaagtcacacaaaataacggaacggagccgccgtttcaaaatgaattctgggatcacaaagaagaggggctgtatgttgatatcgtatcgggaaagcccttgtttacttctctggataaattcgattctcattgcggctggcccagttttacaaaaccgattgaggaagaagaggttgacgaaaaactggacacaagccacgggatgatccggacggaagtgagaagcaaaacagctgattcccacttaggccacgtatttaatgacggtccggggccaagcgggctccgttattgcattaactctgcggcactccggtttattccgaaagacaagctgaaggaagagggctatgaagcctgcctgcatttatttgaaaaatagagctcagcaatgaggcctgcctatcagacaggccttttttctatgtttttttttcttcatgtaatcgttcaataatctttacgattgtgtcttttgtgatgagcggcgcctgatcggattgatatctggggagattgaccttccgaaattccggatgtttggcggggtcgggcaatatcgcgtaaaggttgccccattcatataaagattccgtctcatgaggagaggtcagttcttcatgaagcttctcaccagggcgttttcctacttcaacagcggcggggcgaggcagtccgtgccggaacgcatattcttcaaatccgtgaagcagttcttcaagcctcagggactccattttaaaaataaatgtttctccgccctttgtaattgccgcagattgcagggtgagcgttgcggcatcatcaatcgacataaaaaacctcgtcatgtttttatccgtaatggtgagcggaccgcctgccatcaactgctcaaataaaataggaataacggaaccgcgtgaaccgagcacattgccgaagcggaccgaacaaaacaccgtaccgcggttttgaacatgatgattcgcctgatgaaacagcttttcggacaacagcttcgtagctcccattgtgtttaccggggaaacggctttatcggttttttaagatgtttactgtattttgagggactatcagtgacggtgaggtcgataacgaaaaattaaaccttaggataggggtaatttcaaactgagccggaatcggcccttttcttttttgtgtcatcgtaacgataacttctttgaagaccattcttaatagcgcgttctttttctctgtgcttgattcaatgtgatattgatcaattatcctatttatgttgtttctgactgtattactgtctatttctgattgcgcttcttgagttccattgagctcatgcttggcaatctggagttctttaaattcttcatctaaaacagcttttcttttcaaaaaaagttcatcagtgtaaatgccgctctcatatttctcgaagataaaattctctttgttttttaactcttgttctttttgtgaaagatgttcagacatttgcttttttgttttcacattactatttacgtcttcgtatttagaaatcattgaaatgatatgttttgttaaagtcttattatctaagttgcttaaagaagagaggtaatccaaaatggcattttcaacatcgttatatctcacataagtgcatttattctttttgcaagtgagtgatttaacgtgatatacactttccgtgccgtttttgttttctcgcgttcgcctagtttcgtatttagataatggttcaccgcacttagaacaagtgcatacgcctgccaattcacttaattccaatgcgtttttattaggcagcagggggactttgtttgcaattttctcttgtgattgttgaaattgttcttgatctattataggggcatgtgcatccgatactacaatttgttccttttcaggtctaattgttcgtttaccgtcttttgttttttctctaaccttatatttaacagttccgatatacgcttcgttttgcagaattgctttaattgtgtattgattccagcgcttttttcctgatggagtcggtatttgtaattttgttaagtgagaagcaatcgctgtataactataatcttttccattcaacccatttaaaaagaggttaaagatgagttgaacgacttttgctttttcttcgactgggactagtttggatgtttttttgtttaaccggtatccataaggcgctagtccggaaatccatttcccttgtgccgcatatgtgtatttagcgcctgtcatacgctctctggtcatttcaaattcttctctggccataaacaattcaaaacgaatctgacgcatgtctgcagggtttcgagggtcataaactttatatggtgtaatgataatcaatcgcttgctttgaagaaggttaacaatttgtcccgcatcactgtagctccctcggctgagtcttgttatttctttaacagcaattgcctggtacttgccttcctcgaggtctttaagacattctttaaaaacagggcggccctcaatgctttccccagacccgatttccatttttaattcataggggatttcaatcgacttcagtattttattcatgagttctttttgttctgttagcgtatcttcgcctgttcttttttctcgctccatatcctgacgagagcgtctaagataacccaaaatatttgtaatgttgtaagaatgaacgatgttttttaattccaaaaaaacagcacctcctctttattgtatttactgtaaaaacagtagtattcgtacaatattctgtctgacattgaacacgaaaataacctaataaatattgtaggggctgtattctttaagtgttgggctaaagagctcgctcatacgctctatgttttttgttagcctgagaaaatacccaaataaaaaaagaagcctcagaggacttcaaaataattaattcttctcacatgcaaagttgtcattatcccgatccattttagatgtataagcagggtgagtgcttgatacaccatgcggatatttctttctcagctctgtgcagtttgcaaagtgttctgttcctccaacagaaggggaggcttgtgcagagttagaagagctgcttgatgctgaaccgcttgagttcgatttatgtgtctcggattggtgtgttgtaactgacttttgagccggcttagatacacttactgatttcttcggtttcgttacgcagccattaaatcctttatcagtcgcatatccattcttactccaaatcttcaagtctttatctttcgcagcttgctcatctttcttatacgtgtttaaatacttcgtgtttggctcatatacataagctactcgtgctaatccttctttaagcagtgtttcttgtactgatttgccatctgcataaacgtaagccagcattctgccatacttgtctgtacgatctcctttatcaaactccagttgaagttttcccttgttaaccagctgtttgtttcttgctgaagcatcctcaccatatggttgtacgcaagagtttgggttcttagttttaggcgtgtcaacaagtaaataacgaacagttttgacttcgcctttatagttaactttaatcgtatccccatcaactgttctgttaagtgttacatcgaccagctttttctttttgtcagacgcctttttatccgacgaatccttctttgaagcattttcggctttttcatttttgtcattagtacttttgtcatttgattgagtgtctgcctttgtctcttttgcatccttttcttcttgctctgttgttttagcttgatctgaatctgttttatctgtagaagcagaatcagatccacacgcagccaaagaaaagcttagagataatgcgccaatacctaacagccatttcttcaatgtaattcccccaatttgtttgttctgtctctatatcggacaaaccttcctaattataagtataaaaccaaagattgtaaatttcattttggcattttaagacactcaaatacagttgtgtggtaaaatttagtgactcaaacaccttagaggagggaaatttaattggaagaaggaaagttaattcgcatgactcttgatgggataaaggaagctgtttctaaatacggaacttttcctatgctccaacatggagggcatgtcatggaagatgctgcttttcaattcagagacccagccagtcctcaagaaattaatagtttagaaaagatgttaggggtaactttgcctaatgattataaagagttcctattcaatcacaatggaatggaaatgtttaatggtattgagcttcttagtacagaagggataattgaatttaatgaagttcaagacttccctaagggatatgtcctaattgggtatcattatgatggcaggtatgttattgatgtaaacaaatcaaataaagggttggggtatatgttgcatctggattcaattgataatattgaagatgcggtatatttagactctaactttgagatatggtttgacatgttggtgtcatcaaacggaactaagtactgggaagtaaagccaaaaattaaagagtattataaatatgtttcagaatagatagtttagataagatcaagtggaaaggagccgtaaatgaaagtatttgaagtagcctcgttcatttcagccgcagaaaagcgggcaaaacaatacgatcagattagagaacaatttatcaatctcagaaaagcatttcagggaatggctgatttagatgacagtgagttttcaggcaaaggcgccgacaacattaaagcattctttcaagatcacgccggtgtcacagacagctggcttgatctgatcgatatgaagattgcgtttcttaacagtatttctggaaaagtatctgatgccggattggccgattcgtttgtggaagagtcatttttagaacacgagctgattcatgcgaagaataaatcacaagccatcatgcaggagcagcgcaatgaactcaaggacatcataaatgaaatcagcgatatcattcatcttgatgttttctctacagaagatgtcgatcaaaatctggaatcagcagacaaaaaacgggacgataccgtaaataggctcggcaagcttgatcacgatctaacaaaagaatacgccgaaacagaagcgaacgaacagttcatccaggccgactttcagcagctccaaaatgccacgggcaaaggaaaaaacgccactccgcttcactataacgccaaggcgtacagggaaagtgacatacataagaaaaaaggcgagattgcaagacattcagacacatatttaacgtttaagaaggaagaagcaaaagagcggaaaatcaaggatctgaagaaaaagctcgctgacggtgtgaccgatccggatgaatacttggaaattgcgaagaagatcggctatgaaaaccttgaaccttcccagcagcaatatgtcattcagcttgaacaagcaaaacagcttgaagaagccggagaagtgacttgggatattttaaaaggagccggcgttggtttatatgatgtcgggaaagacacggttagcgggttatgggacttcataaccgatccgggagaaaccttgtcagcactggggaatgcagtacttcatccagtaaaaacatatgatgctgtttcagcagcaattgaggaatcatatcaaaaagatatggtgaacggagatgcttactccagatcaagatgggtgacatatgcgataggtacagtagttacctctgtggtaggcacaaagggagccggttctcttacaaaagctgacgtagcaggaaaagtcacctctaaagtcaataaagcaggccaaaaactgaaagatgtctcaattgctgatttattgccttataatccccgttacgatgttgttccggctggaggagttccttataatgtagttaacagtgaaaatttaaaggatcggttacttagattaattgaatcagcaaatcctagaacggtattaccaaggaataaaggtcgatgggaaggcgcacctggtgacggaaaatggtattccgacatacctgaagtaaaagcagcgactaagggagaaccgattacttttaaaaatggacgtcctgattttactccatggactgttgcaaacattaagtttaagtctggtgaattaaatggaacgaaaaaagattttaggcttgtttataaaaaaattaaagagatcaaggttttaaatctcaagcgcaggcgaaaaaatggctgtcacaacagggacttaccccacaccatttggatagtgtcacaatacaactagtgcctagtgtgattaataacaaaatacctcatattggaggagcttctgatttaaggggagggtattagaatgagtttcaataaaattgaacaaaagttaaaagaatttacgatagatactgaaacagaatccaacattaatacaaacgagcagctcaaagaaattgaaagaaatataggtaatcaattgccttccgactataaggattttttgaagggatatggaggctgttatttagaaagtaaaaaaacaacagatgaagttgagtacgacgtttgctataaacctatagagaaagatccttggatgggtaaggaagatgatacacaattactagagagcttctatggtttagctaacgatcataacagtctccaagaagcaatcaatacttattctgatcgctttcctaggaatattattcctatagcaagctcggcaggtggtaatgaaatatgtatggacatcgacaatgaaaaagttttgttttgggatcacgaattaagtcagcctgataaagactttttcctaattgccaattcgtttgaggagtttatcctaagtttagtagacgaaccaattgaaacggatgatagtgacagtgatgtggaaattgagattttagacaatgactttggaaaattgctctttggtaaggacaattagcttttatttttaggaaaagtattgcaaagttaagctctcagaaagagagcttttttattttcgatagaaactaattataaaaagggagagaggttatggattcgtaccaaataaagaaattaaaacccgaagaatacaataagtgtaataatatttgggacatggaaaagaaaatggctaaggtgttttatgacgaattagtaagcggcaacagaattacttttatttactcagtgaatgacgagtttataggagaaggattgttagtttttcaaaacaatgacccggattataccattccggataaacgcatttatctatctcgtatgattgttaaagaaggatatcgaaatcgtgggataggtggcattattgttgattatttgattgattatgctaaacaactaggatatgagtttgacaggtggtcacaaatcataaaataaaaagcccactcatatgagtagggctaaattaattaattttttaacctccgactggcctttcagctatctggatgttagatggtgaatctgtactcaattgcgttaaagctaccccacttaaaattacagttaaaatagatacgcaaagcacaatttttttcataagattccctccacctgattcattttctgttcagcccaaattttttcattgaaaaagcttgttgcttcttcaaaagcacctattgattcaaacctttttgcagctatgtaggacaattcatctacactttcaaggtcattttgttgttttaaaaactcaatataacggatgcaattattgaagttgttttttaattcaccgcaatataggttgaataggatgctaattttggcttcgtatatcttattctccattaatatgagtctttcctgtgctttattgtaaaaattaatggctttcattttttcgtcaattttaaatagttccttaatcatcatgaataaagaatttatataataatttgaattcatccaagattcattttcaatagctttttcgagagatttaatgcacttatcaggtttgtcccaatcagaatacacgatactaagattgtgatataactgagcttccaaatattcatcctgtgtttcttgtgcaatgtctattgcttctaaataatatgtttctgactcttcaaaccgtttcatatcggaatagtttgcagccgcaatcattgttgaagttgccagtttgcatttatagtcagggtgtcgcttatatattgcaattgcattcttgatatagtgttgtgccacaatgctttgtttaacaagagtgtataagtaggagaccttggagtagaattcagctgcttcaatttcatccggaatttctgcaagctttttctccgctaatccatataagttaattgctcgatcataatttttgttgtatgcctcgtacattgcttcgaataaataaaagttatattccaatttatcgttcgttctttttatgaaattttcattctcttcagtgaaataagtgtgcttttgtaaaggctctccgcgtgaagagtgtagcaacattttgtgtctttcttctaataaactgtaatatgcaagaacttcttgatcctcttccatatcatcgaacaggcttttaatctctgagtaatattttattgactcatgtaccttttgtttctttatagcaatgtaccaatcattcagtgtagtagcaacaacttctgaagcgatcttgctcatccaaacccctctttctgaaaatttcaaaaatcctttggggataatcataacatagtcattgaaaaagttgtaaaaggatgtagagattttgggattttctaatttgaaaaaacgaaaaaaataccctcctcgttagagaagggtacgtgatcagtttgctgttgcttttagtgaggcaagccattcacctaatgttcctgagaaaacttgttgaacggctaattcatatgctgattttccatctttaccggcagcgccagtagctccagtactgcctttttcaccttttaatgaagctaaccattcaaaagtgatgaatattcaaggcgggagtaaggaaaattaacaaaaaaatgtgagggaatgtagataaaacgatttatcttggttataccgttattggctgctgttattgcctctccaactcaaatgaaagcaagtccaatgccttgtagtgcagtactcgaaccggtaaatcaaaaactgaaaaatgcgaagggtgcggcactaatctataaagtgcagttatacccgccaagtgctgcaagaacgaatatgagtattcttgctgtccaccttcctcaaccatcttcttatggaagctacgacggttatgaaggatttgcctccaaaacaggagaggtcagttggcgatttaaactatatccgactcccgaggaagagagccctaattgggctggaagggttgattccatatcagctgaaatgacaaatgttaaagtgcaagtgcgcctttcaaattctaagacgcaaaagttggggccaagtgtattaacaaacaatattcaatcttgctattagaaatgtagagttcttatcaaagagagcaatgcgactggatcttttgtaaattgtcaaaaaggtaattgatcgagaaattctggtgaaaaatgaagaagagtccattaagatggaatgtctggagtcaattcatcatttgatagaagagagccggcaaaaatcgatattgcgtttgattttgtacatagaaagacggcataaaaagaaatggttagctaaaaaaaggcaaagagtcaacgctctttaccatcaggtgttttccttaagcggtctgcaatatgcttaattaaattcagcgcagcagtcactaatccaataactaaaacaatttcaagtaagaggataaatccaaaatttaaaccgcgactttcaaagtaatcatcggtaaaaaagagcaattgataaattccaagcattagcacaataaaggaagtgcctataatcgccagagactttttagagaactccttagtatggttgaaattataaaccaataagaacaaaaatagacaagccatggcgatcttatgagtcaatgaatcacttgctgagaacccttgcacaagtaaggagataattaatccggtcattccgattattttgttcaatatatcacctgctttgtataagtatgaccttagatgtcagcttaccaattaaaggtgatattctcaacataatgcagtttaaacttaacttaaaatcgtaattttaagaacaaatttagagtggatcatgacatgctgtttattatgctgtaaacaaacgcaacaataaataatggataagagataatagcaattagttttgaagatttgttctttttttcaaatgtgtatattagtgcaaatcctaaaaagaatattgtgacaaaccaagaagaataggacgggtacaatgcaataagtaagacaataagagtggataacgcaaaagaagagtttagcgttattttctgatcgtttttcaaataaaccgcctccttacacatattccccccatataaaaacacttaaacattatattaagtcagcatgattaaatgataaacattttaagtaaagaacaagataaagcaatccggcatttcaagacaagctgaacatgtctgaaaaactgtacatatccttagttaatgtaaactgcttatagataagcaaaatgattaagcggaaaggctgtatagacttataggaccttatataaacattagatcgcttaaagaaggtgatgtggttgatcagccaattgaatatttcatgatgcaattgtgcggttctataatggtgaagacctcgccgtgttccatttgtctagggggggaatttgtttaaattcataaacatgaggcgttttagtctgtcatttcctaaaacagtgttttattcttgttacaaatatgcaagaagggcggtttgaacttgtatagagtgtttataatgctgttaattttgttatgtataacattagggtgtcaaaaccaacataacaaacattttatggaagctgagcaaaccatggtcggctatgtcatttttaaaggagagaatcaagcaattctcacacctaatgaaaaagctgatgttaaagactatgaaaatcttagtgaaaaagagattattgaaaagtatagatcggatatagttttactgggacttagtcaacttaacaataaagatgacttgagcaaagggcaaaaaattcgtatttggtataaaaaattaaatgaatcttcaccgccaaaaacaaacatctcaaagtttgaaaggatttagtacatattctgtaattcctaggaataccgctgaaaaaactgaagcggcatattgaacagaaataatgtcttcaaaccttacctcattcgcggtggcttaatcctgccccaagatttatttgacgattgttgactcaggtgcagagaaggcacatgccaagaacacatttttgaattactgggcaccttgaataaaaccagcattcccgtattcatatgcgaagagatctgtctgaacgctggataagttaaccatacatttgaacaagcttgcgaggctttgataaagaaagaacagtcaagagacgaaccattacatacatataatactcctgtgaaagcgggggtgtagttttggaaccttaccaacgttatgaggaattaaagaagaaaacaataaaggttgtccataaagataattacagtatccgctatatagatcaggatgaagcgagtaatgacttagatgaattttataaacaatttgctcagcatttattggaggctgctttggaaaggagtgcagagtaagcttctttttttgatttgtttgtagtaagtatcttaataaacggctttatcggtactgatattaatcacatgcgtcacctcttgcagcaaagcggcttctgcgacattttgtccgccgataaggttggtttgaatggcttcaaagggattatcctcacatgtcggaacctgcttcagcgcagctgtgtgaaagacaatatcaacacctttcatcacttggttgactcttctgtagtcacgaacatcgccgagcacaaatgacagtctttgttcatccgcgtatttttgtttcatcacatattgtttgctgtcatctttgctgaacacaatgacttctttaggggttaagagcaaaaggcgttttactatttggcttccgattgatcctgtcccgcctgtgacgagaacagttttatcgtgaaaaaacggttgtagctctactgcttgctgtttaggcatggcttatcctccaactctcgtttctctaccatgcatcatatgttgaacaatttcagcgagttaatgaaagaaaccaataaatcaaaaattagagaaaaacattaatctgatgcgctttcatatcgctttacccgattaatagaatagaaatcacaaataaaacattgtactaaatgttcattctaaatatttgctcatgtcaattctttctcttcataaattctcacatgcggacaatcttcacaaaaacttaacactgaacttcctgtatgtattttacaattaaagtacactttcataaaaggaggaaggaaaatgaatcattcaaaaacacttttgttaaccgcggcagccggattgatgctcacatgcggtgcggtttcttcccaggccaagcataagctgtctgatccttatcattttaccgtgaatgcggcggcggaaacggagccggttgatacagcaggtgatgcagctgatgatcctgcgatttggctggatcccaagaatcctcagaacagcaaattgatcacaaccaataaaaaatcaggcttagtcgtgtacagcctagagggaaagatgcttcattcctatcctaccgggaagctgaacaatgttgatatccgctatgattttccgttgaacggaaaaaaagttgatattgcggcggcatccaatcggtctgaaggaaagaataccattgagatttacgccatcgacggaaaaaacggcacattacaaagcattacggatccagaccgcccgattgcatcagcaattgatgaagtatacggtttcagcttgtaccacagtcaaaaaacaggaaaatattacgcgatggtgacagggaaagaaggcgaatttgaacaatacgaattaaatgctgataaaaatggatacatatccggcaaaaaggtaagggcgtttaaaatgaattctcagacagaagggatggcagcagacgacgaatacggcagtctttatatcgcagaagaagatgaggccatctggaagttcagcgctgagccggacggcggcagtaacggaacggttatcgatcgtgccgacggcaggcatttaacccctgatattgaaggactgacgatttactacgctgctgacgggaaaggttatttgcttgcatcaagccagggtaacagcagctacgcgatttatgaaagacagggacagaacaaatatgttgcggactttcagataacagacgggcctgagacagacggcacaagcgatacagacggaattgacgttctgggtttcgggctgggacctgaatatccgttcggcctttttgtcgcacaggacggagaaaatatagatcacggccaaaaggccaatcaaaattttaaaatggtgccatgggaaagaatcgctgataaaatcggctttcacccgcaggtcaataaacaggttgacccgagaaaactgactgacagaagcggaaaataaacatgaaaaaagcagcttatccaagctgctttttgatgtgaagagcgtttcatgagaaagtcttggaacggatagccgcaagcacagccggaatctggtcatacgtgtacgccgggactgtctcttgataattaagcgccgcggtttgtttacgttcacccgggtttgtcatataaaaatggatcttatccgcaaaatccgcaagcccgctgtaagaaacaaaggatgaaaacgggggcgcgggagaaaggtctgtcagctgaaaggcctgacaagccgcaatgtctaagcttctcgtatttaaactgatattttcgatgccgcgtccgttctgattgagcgcaaaccgataagaacggtgagggtttaagaccacgtctgcgctgttgtaatataatgcggcacgttcgggtgcaatccattcatccattacgagcacattttgctgcctggcgatttttttaggcagatgtctgcgccatcccttcccgatgatacgaagcgtatacggaagcttcgccgctgctttcaccagttcaacgcggttcgggtacgggtatccgatcagaagcagatttgtgtgaagagaagcttcagcaggttgtttcttaaaaagccgctgattaacggggatcgggacataatatacgtgctgtaagcccatttgccggtaagcatcaagcgcgttttgttctatcgttaaaacggcatcggcgaaaggggcgattgtcatgctcacatcgaaataaaaaggatcctccgtcatccatagataaacgggaatctgttctgtcttcagccattgaagccattcagacggaatacggtctcccgtcatcatcagactgatgtctggtttgaatgcccgtatactgcggatggtatcttcctcaaactcagaaacagaaaaaaagcggacggaagactgtaaaaagccttcctcaatccagcggtcaaaatacgtgtatatgcctttatatcctgaacggatatataaaacgttcatatgctgttacgaagtgaacgtgacactttcaactttgtcgacgtcaagcaatgttgtagcagagcctgccggtgtaacggaattttcctgcgtaacaaaaacgattccgtgaatttcgtcaaaggcaacaaattgaaccgggccgatcatgtctcctgaatccatcacaatgctgatgacagtgccgggctgaattcttgcaaaaatccatctcgcagctaatgaaataccgcttcccaatacagattgtgcgctgagactgtctttcgccgctgcttcatctacttttgcatcaattgccgattccaataattcttttactttgttttccacattatctcctccatctgtaccgccagataaagcgctgttgtcaaatacaggggctaaaagagttttcaataactcctttttaagctccaaacgatcctcgctcatgcggacatacacctcctttaacaatttcaacctcacgtttattcatattcctgattgaagagattggtataagtcgaatgccgttttgcttgtgtttttttcaatatttaatcaaacagctgaattttcgaatcaggctttgtttgcctatgcggtttgtaagagtatgacatacgttgtatagattaaaaaatgaaggagaggaatattttggattcggaagaaactgtaaaacacgggggttttgaggaggaatttcagctcgtactgcttcttcttcttttgttatcccgtcagccgtccggagatcattcagatttgcggcgtcagcttgtaatggcaaaagagcttggggttcctgtatcacgcgtcaatctgattaacggcagcacactgcaaaacgtaattgtcaaagaagtgctgtcagatttggccgtttttcaaaatccgctcaatcatacgagatcaaacgtcgcgatttcaagcatcgtcagctggggtgctttttaataacggatatcaggctctgtctctttcggagccgttttttatgtttttacagaaggggtgatgggatggaaaagaagatctcaattatcttaacgagttacaacaaaccggatcttgtgaaacaggcgattgaaagtgttttgcatcagacctacagcaattgggagctgtttgtaatggatgatcattcaaatgaagaaacctcggctgccatcagtacgtatataaaagatcctcgcatatattatgacaacagttttatcaatcctgccgaacggctgaagtccacccggtatgccgttttgattaatgatgcgctttcacgggctaaaggtgaatacatcacttatttgacagacgacaccgtatttcatccggataggctcagccgcatggcggaagcgcttaatcaatacagcgagtttgatgccgtctattccagccagaaggtgatacatgtaaacgggcgcggaacagaacaattccacttctatcgttatgctgaagaggtgctagatcaggccgcttttctcgttgatcactgttcagtgatgcaccggagatcattgcttgagcgtgtgaaagagaagttcggcagcttttgggacgaagatgttatgcattggaatcacggagactctgttttttggagcaggctcaacacatttacatcatttctgccgataaaagaagtgttggatacgacctataaaacaccccactcatttcagaacacgtatcaatcgcttccgtctgtcctgatcgacggatcctttgtaaaggggacggatcagaaagtatatcagcttgaccgaaataaaaggaagcctgtaaacgagcgctggcatacgttatatgaaggccgaaccgtcgtcattccggatccgtttttatttcaatatgaggaagagaactccgtcagtattccgaattttcagctcgtcagggatcagtttcatgtttattttatagaagacggggagaaaagaatggttgatcatagcgcatttcgcttttaccgatttaaacggcatgacatcccggctttagagcggggcgaaatacaatcgcttccggacggtccgccgatcagccgggggacatcgggctgtattcaacatctgcccgggagaatgctgtttcgcattgaacgggaattttatgtttatttgagaggggttctccatccgatcagtcatgacgtagcgaaacgcttttttgcgaatcagaaggcgatacccatttcctttcagcaaattaaacaattaccaattggaatgccgttctatccggtgtacgatgaaattatgagaaatctcaatataacaaaaggttgagagatgcagttggatgtgtaaggaaaaggagagcttttatgaccgatcaatttgataaaaccgagaagcagtatatagagcttacttccggcattcagaggttcgagcatttcagtgtatatacggacccttttttgccgcagattttttcgcataactttgttcagctgcaccgtacatttccgttagacaaactgctgccgtttttttcgtccgttccgggcttgcttcaagccaattatattcatgtgaaagcggctccggagcacgcgtttccgcttcttctgaaacaaaatctcgtaaagcagggctgcgtagtggaagatgagctgttttttgcaaggaaactggaaaatagggacctgcaggccggacacccgctcactgcttgggggacggaaaaaagcctcgccgacgggtcgtctattatgaacatctatgatgccctttacattggcgaggcggcggccgaacaaaagcttgagcggaaatatcctttgtataaggacggaacggttatgcttgtcgtgtgctacagcgacgcctcgcaaacgattccgatcggctgcggagagcttttcatcaacaaagcagataaaaccgcaaaaatagaagaagtcgcaattctggatcaattccaacgaaaaggctacggatcgatattgatgaatgagctgatggcggcggcaaagctgaacggcatggaaaccgtataccttgtgacgtccgggatggacggtgtaaaccgcttttatgaaaaactcggcttcaaaagatttcggcgcgtgcatacaatttttcattattttcttacatagttgggcattcgcataaaccaattgggagttggcccgcatacaatgccgtatatcgtaagaagaaaggatgatttgcgtatgtacggatacggatatggctacggttgcggcagttttggctatggttacgggcacggcggctgcggaggcggaaccagcacttttgtgctgatcgtggtattgtttattttattaatcatcgtcggtgcggcttttatttgttagactgaaaaaaatcctataatgaaaatcagcctgcagagaacatcactttctgcaggctttttgttatttccatgctgaaaaatcagcttgaaaaacattttaatacatactacctttctggagaagggggcgaaaatgtgaacataacgattgaagaattacctgaatccagaattgcttatttccgaaacatcggagagtatggcggaaagcaaaacaatgaactgatggagtcatttaaaaactgggcgcaattgaatggtctgcttgatcattctgtcattttaggaattccgcaagatcatccgaatcgtactcctaaagagaaatgccgctatgatgtttgtcttgttatcaatcaagaccatgtgcctgaaccagcccggatcggtacattttccggagggaagtacgctgttttcttgcttgatcatacaaaagaggcagtcagtggattttggaacactattttttctgagatcgaaaaaaataatttatcaatcagagagcagcccattatcgaaaggtatactttccaaaaggtgaatcatcatttgtgtgaaatattgattcccatacagtaaagaagacgggaattttccgccatctgcttatactgattcagatcaaaaatgatgtgataatgagctgagcaaagaataaaatcaacaataggaatagaatttccagaacgcttttcaggctgtcgggacatctccggcagcctgttttacagaaaggtattttctgcaaaaaactttctgaaggataagaatgcggttattcatctgttcatacaatgaagcaaatgggttttcgaggtggaaagatatggggagctatttaatcaaaccggagcttgacgggaattatccgtcagtcagtcatggaaagggatcatatgtgtatgatcaggaggggaacaagtatcttgacggagcatcgggggcggtcacttgcaatatcggccacggcacggaggatattatacaagctttaaaagagcagcttgactctgtttcgtttgtgtatcgctcgcaattcaccagtactccggcagaagaactggctttatttctggcggatcatctgccgggcgggctgaattggtcattttttgtaaacagcggctcagaggcagtcgaaacagcgatgaaaatggccgttcaatattggcaggaaaaagggcaataccaaaaatccgtctttctatcaagatggggcagttaccacggcattactttgggagcgctttcattatcggggttctacgaacggagataccgcttcacccagttgctcgaacggtttcctgccgtttcagcgcctaatatgtatcgttcagagctgcagggagaggaatttgtgaaagctgcggcggctgaactggaaacggctgttcagcggatcggttcctcatttatcgcgggatttgtcgcagaaccgattgtcggagcagccggggcggccatcactccgccggcaggttattatgaagcgcttgaggatgtctgccgccggcacggtattttgtttatcgcggatgaagtcatgacggggctcgggagaacaggacggatgcttgcttctgagcattgggggatcgcacctgatatcgcggtgctcggaaaagggttaggcgccggttacgctccgatagcggcagccgttgcgtctgatgacatcattgaaacgatcaagcggggctccggggtcattatgagcggacatacgtacagtgccaacccatactgtgctagagcggcgcttgaagtgcttcgctatgttaagaaacacgatctgcttcggcagtcagaggagaaaggcgtaatgctgaagcggaaattagaagaaatcaaagagcgcagcggggtgattggggatgtccgcggtaaaggcctcctgatcggggttgaattcgttaaggataaaacgacgaaggacgttttttcgaaaaaacaggccttcaccgaaaaaatcattaaagcggcaaaaaaacggggcctgcttatttaccctgcaaagcccggtattgacagcggagaaggagacgccgtcatcatcgccccgccgttcacgatttcatatgccgagctggatgagctgtcagatctattttcacaggccgcagaagaagttgaaaaaatgatgaagaaggattgagctgatatgtctatttttcataaaaaaatcgatattcatgaagcaattgccgatgtcaaggacgaatctgtcatcatgttcggcggttttgggggagtgggttcacctccgtcattaatcgaagcgattttggaaagcggcgttaaagagctgaccgtcatctgcaatgatgccggatttccggaaattggcatcggcccgcttatcgttcataagcgggtaaaaaggctgatcgcttcccatatcggctcaaatcctgtcgcgggcagacaaatgactgacggagcgcttgaggtggaattttcgccgcaagggacgcttgctgaacggattcgtgcaggcggagcggggctaggcggtattttaactgatatcggcattaataacgcaaccgtttgtgaaaacaaagaaaccgtaacgattgacggaaagtcctatttagttgaaaaagcgctgacggctgatttcgcttttgtgtccgcacatactgctgatgaattcgggaatctgacgtttgacaaaacggcgcgcaacatgaaccctctgatggctgcggcggccgaaagaacatttgctgaggcggcagagattgtgcctgccggcgaacttgacagcgagcatattgtaacgccgggcgttttcgtggagggtgtcgtgcaaagtgaaggagtgaagtggaaatgggcttgggaatagcggaaagagagagtatcgcgaggcgggccgccagtgaagttacctcaggtatgattgtcaacctggggatcggcattccttctttagtgccgaactttctgcccgccggcatggaggtaatgctgcaggcggaaaacggcgtcctcgggatcggcggcagtccggagcgcggagaggaggatgagcttttatgcaatgcggccgggtttcctgtcagtacagttaagggtgcttcctattttgattcagctctgtcttttgccatgatcagaaaagggctgatagatattaccattttaggcgcgctccaagtcagcaggacaggtgatctcgccaattggctcgtgccgggaaaaaaagtgcccggaatgggcggggcgatggagcttgcccaaggcgcgaaaaaagtagttgtcgtcatgagccacaccgatcagaaaggacggccgaagctggtcgaaagctgttcattgccgcttacagcagcgggctgtgcagatctcatcattacagagaaagccgtcatcagcatagatgatggggcttttgttcttgaggaactgctgaatggcacgaccatagacgatgtcattcaaacaacggatgccgagatcagattgggagaatgttttcttaaaagggggcctgtccatggatcaattagaaaagaaagtcactgagtgggcggaagaaaacacagcaaaagcggtaagcttgctgaaacggctgatcggggaaaaaagcacgttcggccatgaatttaacgcgcaggcagtcgttttagaaaaactgagacagtttgacatggatattgatgtatgggagccgagtgtcaaacatttgaaagagcatccttatttcgtatcggaacgcgaagacttccatgaaagcccgaatatcacagctgtaaagaaaggggccgggggcggaagatcactgatactgaacggacatattgatgttgtcccggaaggaaatcccgccgcatggacgtatgaaccgtttaccgctgttgaaaaggacggcaaagtttacggccgcgggtcaacggatatgaaaggcggcaatacagctctcttgtttgcgttagaagcgcttgaagcctgcgggattacattaaaaggagatgttctgtttcaaagtgtcatagatgaagagtgcggcggcgcgggaacactggcggctgttatgaggggctacaaggctgacggggcgcttattcccgaaccgactaatttaaagctgtttgttaagcagcaagggtctatgtggttccgcattacggtaaggggattgtccgcacacggcggcacccgctatgaaggggtgagcgccattgaaaaaagcctgcatgtcatcacagcccttaaagagcttgaacacgtccgcaacgcccgtatcacagacccgctttatcgggacgttccgatcccggttcccattaatatcggcaccgtccaagggggaacgtggccatcatcggtagctgaccgtgtggtgatagaaggcaggtgcggaatagctccggatgaaacgcccgaagcagtaaaagaagagctcgcaagctggctgaaagatttggagtaccgggatgagtggtttaaacaccacccggcggaaatagaatggtttggggctcagtggcttccgaatgatctcccggatgagcatccgctgatttccgctctggaatcttcttttgagaaaatgaaaggggcaaaaccggttcgtgaagcgtccccgtggggaacggacggagggcttttgcagcacgcgggacagacgccggtcatcgtcttcgggccgggagaagtcaaagcggcgcatcaggcgaatgaatacattgaaatccgggcgttaatcgatgccgtcaaaatcatttctctttttatcatggaatggtgcggggtggcagatgggggtgacggagctgataaaggaactgagggctgaaaagggagcggccgagattgatgcagaccgtttcaatgagcggctcagagtcattcgttatgacggacagatcacggcgcttattccggccgttttggcagaagcaaagcaagaaggagcccaaaaggtaattttctttgccaagcgcggcgatgagccggaatttgtcaagcatctttttattgttgagggtgtcatagacgggtattacaacgggcatgaggctgttgtgatggtgcgctatttagcagaggaacggagacggtcagattcatatgtatcagaagattcgactgttgaccgtttatatgagacaccgcggcggggactgactcaggcagaaagcgcgctgatgttcagaaaagcggatgaagatgatgcagaccgcttatcgcacttatataaacatgtttttcttacctatccgactcctgtctttaatcccctttatattaaaaaaacaatgagagaaaacaccatctattatgccgcattcgatcaggatcgtctcattggggcggcaagcgcagatatcaatccggtattggggcacgctgaaatgaccgattgcgcggttctgtcagattacagggggaactccgtaacggcacacttgtttaaagcgttggagcaggaactcgcgggccggggaatcatccatcttttttccttggcccgtgcagcgtcttacgggatgaatgccgttttgtaccatgcgggatacggctacagaggcaggcttgtgaacaactgccgcatttcagaagggctcgaaaatatgaatatatggtgcaagactttacgtttggccattcataaggaggaattcgtttgacaaacaaatggtttcagccgaagcgtcattggaaggagattgaattgtggaaagatgtgccggaagacaagtggaatgattggctgtggcagctcacccatactgtaagaaccgtcgatgacctgaaaaaagtcattcatttgaccgaagaggaagaagaaggcgtcaggatgtctgtaaaaaccattcccctgaacattacgccttattatgcttctttaatggatcccgataacccgagatgtccgatccgcatgcagtccgtgccgctgtcagaagaaatgcacaaaacgaaatatgaccttgaagatccgctgtttgaagatgaagattcaccggttcccggtcttacgcaccgctatcccgaccgcgttctttttctggtgacaaatcaatgctcgatgtattgccgatattgcaccagaaggcgtttttccggacagatcggaatgggggtgccgaaaaaacagctcgatgcggcaatcgcttacatccgggaaacgccggaaatccgtgactgcctgatttccggcggagacgggcttttaatcaacgatcagattctggaatatattttgaaaaacctgcgtgacattccccatcttgaaattatccggatcggaacgagagcgcccgttgtatttccgcagcggataacggataacctttgtgagattttgaaaaaatatcatccggtctggctgaacactcattttaatacgagcatcgaactgacggaagaatcggttgcggcgtgtgaaaagctcgttaacgcaggtgttccggtcggtaaccaggccgttattttagcaggcattaacgattcggtgccgattatgaaaaaactcatgcatgatttagtgaaaatccgcgtgcgtccgtattatatttatcaatgtgatttgtcagagggaatcggccatttcagagcgcctgtgtcaaaagggctggaaatcattgaaggactgaggggccacacaacgggctttgccgtgccgacctttgtcgtcgacgccccgggcggaggcggtaaaatcgccctgcagccgaactacttgctctcccaaagtccggagaaagttgtgatcagaaacttcgaaggggtgattacatcttatcccgagccggaaaactatatcccgaatcaagccgacgactattttgaatctgtttttcctggaacgatggccaaacgcgagccggtcggactgagcgccattttcgcggacaaagaggtttcgttcacaccggaaaatgtatcgaggatcgacaggaggaaaacgttcacatcaaaccctgatcatgaaacgctgaaagaccgcagggaaaagagagatgaattgaaagaaaagaaatttattgcacagcaaaagaaagagcaaaaagcaggatcggaagtcggaggtgaatcgccgtgaagccatgcgagtggtgcggcaatcagaaggcgtcagcttgtcaggcggctgtgtactgggagcttcctgacggtacgagggccatagaaattacagaaacacccgcattcgcctgttcctcctgcagcatgacttatcaggaggaagcggtcatagcggaaatcgaaaatcagctttttttagtcaatgcaaaaaaattaccggaaacactcacatatcaagagctgatggagacagaacggatcttgaaacggaattattttgacttctcctagtcttcttttgttgtaatttcacacttgaattgtataatagtacaacaaaagacagtcatcaggaggggaaacccatgaaatccttttatcactatttgatgaaatacaggcatcccaagccgcaggacgcaatcagccagtttgcgaatcaggcatacgaagatcacggctttccgaaaacgtcaagcgattatcacgagctcagttcttatttagaactgagcgccgactatttagaaacgatggcgacatttgatgaagcttgggaaaaatatgagaccgaggtgcatcacgcctgacgaaaaaccgcacattgtgcggtttttttctgttgaaatcactcgcttatgaggtgccgtatgatcaaatcccgcaacgccgtccgtttgatcagctcgtaaacacatcttcctgaaggcacgtatcataaggcagtagaatgtatagctgcagagttcaccggatcaggcctgctgacggcggggtcccgggtaaggagcctcttttcacggagaaataatcaaacatttaaatgaagtgaggggaatcaaatgatccattaggtaagactgatgaggcactgacgtttggacggaataggggattttatgtgacaaggttgaagcggattgaagttgtgccttgcaaatatgcagccggaattggatctccctacaccttcgatgatgtgtttcacggcaaatcttgaacatcacggcggtgatattgtcaatatgccttcgggccgggtgtttacctttgcgtcatagagaaaaaacaaaaactcattcaaaataggcgcgttttgtctcagcactgttactgcagtcgatcgagagcgaaatgtcatcggacgcttctgttacggtaagtgaaaaaacgcacaagcatgttgcggtttttgccattttgaacaggtgcagaaatagatatttcctgtggttttcatgcccatgcgaaatgatggcggccggcatacgatagcgtatgacagtccgcggcaagggggagacagcatgaagccagataaaccgaaatttcaagtgggagacatcgtggtcgtcgtgatgtacggaaccgtcggcaccattacgaaggttcatcaaattgataaacattatctttacgaagtcaatcataatgaagtgctttattttgaatcgtccatccagctttataaagattatgagggcgtgatcgtcgatatggaaaaattggatattgaatatgaatttctgatcggcgacgtagtatatgtaaaggactacggaaaggaattattccgtgtcatcggccacagaactgaaatatggagatatttagaggatggctgggaggatattatttatgagctgactcggctgaaagacggagagtggcttgaaacggaggaagaggatctcacgctggttctgagaaaatatgaaatggatcagtttgtgcatcagctgctgtttgtccactatgttggggaagcatctcatgagatcggcgaggataccgtcgcgtctgctcttcttcagtttgaaggcgatgctgatgatcccgataccctgcatgtgctggcggtatcgattgtagatgagctgcttgatatttataacgattataagattctttatcatttgttcggtgacgaagaatataaagatatgatgaattttgtgctggaaagcctgcgggagcatttcagctagccggcaaaaaaacggacggtgacatataaaaaccagggcagacagccggcaaagattacaaacgacattcctttcagcactttttccaatacgacatcaaatccatctccgtccaataaagccatcattttcgtcatcatcttttctccctccggggcttgttttttaaaagtatatgagcggacaaaacgtttagaactttcgggtataatttgaacggttttttcataaaacataaaaaaggaggcggtgtttgcatgaaagaaatagatcttgtgattgacacagaagaaatagctgattatttttacagtcagcttgctatgcgcgggtacataccgagtgaagaggaaatcttcgaaatagccgacatcacctttgattatttattagaaaaatgtatgatagacgaagagcttgatgaagactgaaactgcggaaccgaagtgaaaaagcttcggttttttcaatcagctcgggagaatgaaacatggggggaaaacgttgtacaagccagcaagtcttttcgcattgtttattctgctcgcagcagcgatccggatagaagccgtccgggtttttgatgagcgtgtcatagaagcggctgtcaggatcagggctgcctggctgaatgaattgatgttatggataacggagctcggcacgaccgcggtgcttttgccgcttcttcttttgacaggcgcggctctgtatatgtacaaaaaaacgccggatgttgtttttttgccgcttctctttctcattgaacggattgtaaacataaaaataaaagaattgattgaaagagccagacccgcttttgaaccgctcgtccatgaaacctcatacagttttccgagcggccactccatgaattcggcagtgatgtaccccgtcatcgcttactttttgatcaagcatgttccgtttttcacgaaaagaaaacgggccgtcaccgtctttaccggggttctcgtcattctgatcggattcagcagaatttatttgggcgcgcattttccgacggatgtgcttgccggattcagtctcggactttgcctcgtttcgctttttgcgcttcttgacgaaaagtatcacccgtttcgacaaaaatagagacaggaaaaatgagaaaaaacgctaatactattaagaaataagagggagggatcttgatgctgttatcgctgcccgtgtttaaaaaaaagacttgcgcctatgatgtgacgatttttcaaacaccccgctacggcgagaaaaagggatacagggtcgtctatcggacagagctggccgctgacaatcatcaagacgcactggaaagggcattttctgtttttaatgtgcctgatacggtcccaaacgactatcaagccagattcatagcgaccggagatgtcatactcatagacgaaggaagaaaaggaaagacgtattacaggcttaaccctgcgggatggagcaaaattaaccggctgctcgtccagccgaggtaagacggggccggctgaatcttcagccggcttccgtattgtctgggaaagactgtgttaaggcttccgtttagcggcggaatgctcttttccatgcgcttcatcagctgcaatgacgtctgaaacgggcacgtgattgttctttttctggccggtcacccggttgcgctgttttttgcccattatgttcactcctttttctttaggcttgtcatcccgcatattctgcccaagatcgccctgatcatgctgatgattgtctcttaccgttattcagtgtacaatgggtgggagtttgaataggcaggaggaaaaggaaatgagtgtacatataaacgcagaaaaaggtcaaattgcggatacagtgcttttgccgggagatccgctccgagcgaaatttattgcggaaacttatcttgaaaatgtggaatgctataatgaagtcagaggaatgtacggatttacgggtacatataacggcaaaaaagtatcagtccaaggcaccggcatgggtgttccgtctatctctatttatgtgaatgaactgattcaaagctatgatgttcaaaacttaatcagagtcggctcatgcggagccatccgtaatgacgtgaaggtgcgtgacgtgattttggctatgacgtcttcaactgattcacagatgaaccgtgtcgccttcggcagtgtagattatgctccttgcgcagacttcgaactgcttcataaagcgtaccaggaagcgcaaaaaaacaatcttcccgtagcggtcggaagcgtattcaccgccgatcagttttacaatgaagactcccaaatcgaaaagcttgccagatacggcgttctcggcgtagagatggaaacgactgctttatatacgcttgccgctaaatacggcaaaaaagcgctgtctatcctgactgtaagcgatcacgtattaacgggagaagaaacaacggcagaagagcgtcaaacgacttttcatgatatgattaaactggcgttgcatactgtatcgtaaacttgagatgagggttatgctgattaaagcagccctcttctttatgcatcgccctgattcaaaaaaagaaaggtaagtgtaaaatgaagaaatccactaaatggttctcgctcgctgccgctctcagcgtaaccgcaatcgtgggaaccggctgcagcatttcaggcggcgacagccacaaggacacaaaaacagcagctgaaacaaaacaatcagatgacacatcaagcaaaaaaacaacgaaggcagaaaacagcgattttgtattggagagcaaatattttaatgatattaaagaagtgaacgggcttgagaccattcaaaacccgacaaatacacttgcgctcgtgaataagacatacacgctgccgggagattataaaccgaatgatctcgtgatcccgaaagtcgaattttcttttactgagaaaatcgagaaacgatatatccgcaaacctgccgccgatgctttggcgaaactattcagcgccgggaaaaaagaaggttatgacctggttgccgtttcaggataccgctcttatgacagacagaaagttattttcgataatgaagtcagtctgaaaggtgaaaaaaaggcgaaagaagccgtcgcatatccagggcaaagcgaacaccagacggggcttgccatggacatttccagcaaaagcaacggatatgagctgaatgaagcgttcggaaacacggcggacggcaaatgggtgaaagaccatgcgtatgaatacggctttatcatccgctatcctaaaggcaaagaaaatgtcacaaagtatgagtatgaaccatggcatttacgctatgtaggcaaaaaagcggcaaaagccatccatgaccatcaattaacgcttgaagaatattttaatgaagtaaagaaagtgtaataagaagaagcccgcttgaaaaatagaaagcgggctttctttattaccagaagagtaaacctccaagcgcaaatccggtaatgaaaccaaggccgataccgtaggctgctccccagcctccccagcctccccaatagccgaacccgtatcctctgtgacggccgccgacaggggcgatatacactttgctgttagtcacccgtacgattcttccgacgtggactctgccgtttcgttctgtaattcttgctacttttccctggtgctgccggcaaagatgataatagttttgcatcttttctcctcctatccaacctatctttctatgtcagcttatgatagagtgcggtaaaaaggttggacgaaaacaggaggacaatcgccgttttacttgtaagcgacaaaagcgcagtgtcccatatattcacggtacgtttgcataagctcgtaatgagccgtcagcgtatcgtagtgaaccggctgaataacgggcgataaatccatttctgtagtcggctcccgcgcattgttttcatagacagcgggaatgaaatccgcgttctgaaagccttgctgaaacaatctctgtttccatgccgtttcatcctgcaatacggtaaaaccgtagaagtcttttatctgcgtgatggcgttttccggcatgggcttttgtaaagcagcttcaatgccgatcagcatacccccgggtttaaggacccgcaggatttcagacagcgatgaatcaagatttgaaaaggtgagaactgattcggaaagaacggcggaaaattgattttcagcaaacggaagccgctcaagctccgccaaatagcccggaatggttaagccttcagcggcaaatcgttttgctgctttttcaagcataaggggatccttatcaacacaggtgacggggtacagcaggtggccgagataagcggccgtctgtcccgttccgcagccggcgtcaagaatcggttcgccaggaggaggagccgcttttgtgagaacggctttggaaaaagcgagcccgccggggtgagcccctccgactccgaataaggacagcatttctaaatatttgctcaaaggccgaatcctccttttttcctcagcatatgttgagagaaaagcataggtttgggtaaacgggaaagaagggcgcctcacgtttgaagttgacgaatgagcgttcgtctatgataataatgtaagaataaaaaggtggtgttttcttgaagcggcaatttaaactgttttttattatattgatcactgcggtcgcagcctcggcgcttacgctgtttatcacgggcaatacgaccattttcggacaaggctcggctgctttgacgaacagcaaatttgagaaattcaataaagcctacgagcagattaaaagtgattactatcaaaaaacagatgacagcaaattagtagacggagcgataaaaggcatgatcagttccctggatgatccatattcttcttatatggacccgcaggaaggaaagtcttttgaagaaacaatttccgcttcgtttgaaggcatcggcgcacaagtggaagaaaaggacggcagcatcctgatcgtatcgccgattaaagggtcacccgcggaaaaagcgggggttaaaccgaatgaccagatcttgaaggtcaacggcaaaagcgttaaaggccttaatgtaaacgaagccgtcgcattaatccgcggcaaaaagggaacaaacgtcaagcttgtgctgcacagagcgggtgtcggcgatctgaacctgtcgatcaaacgtgacaccattccggttgaaacggtgtactctgaaatgaaaaaaggagacatcggcgaaatccaaatcacatccttctccgaatcgacggcaaaagagctgaattcagccattgacagcctcgaaaaacaaggagcgaaaggatacattctcgatttaaggggcaacccgggcggactgatggatgaagccatcaaaatgagcaacatgtttatcgataaagggaaaaatatcatgcaggtcgaatacaaagacggcacgaaagaggtcatgaaagcgacgaaagagcgcaaagtgacaaaaccgacagtcgtcctcgtcaatgacggcaccgcgagcgccgcggaaatcatgtcggctgcgctgcatgaatcatcgggcattccgctgatcggcgagaaaacgttcggaaaaggaaccgtgcagacggcaaaagattacagcgacggttctaccgttaaactgacaatcgctaaatggctgacagcggacggagagtggattcataaaaaaggcatcaaaccgcaatatcaggttaagcttcctgaatatgcgagcctgccgtatttagatgcgaaaaaaacatacaaatacggggattccggaaccaccgtcaccaatgcgcaaaaaatgctgaaagcgctggggtacagcgtgaaagtaaacggcacgtatgataaagcatttgaacaagcagttaaacaattccaagcaaaagagaaactgaaacaaacaggcattataacgggagacacaacggcaaaattgatgacggatctgcaaaaacagcttgcggacaacgatacacaaatgaaaaaagccgttgaaacattaaataagaatatgaaatagtaaaaaacacccgatgcgccgctcgcgcattgggtgttttttgtttgcgaaaagcccgtcttatgtcgtttcctgttcaaaaaggtggctgttcgcctgaatgaaaaactgtgattgctcatagtgataggtgacttttgagaagtcaaacggctggccgttggttaaatgaaaaatcgtttcaacgcatagcttaggcgctcctgtaaacagacctaagtactccgcttcttcctcatttaacatccccgcgtacagatataaatctgaaaaaccgcgctttaacccgagaccttctcgaatataatcaaatattgattctgccacgatctctttattcaaatacgtaataatcgatttgttgtaaaatgactcttcgatacacaatgtcagcccgtcaatatatcggattcgcttgacataatacacgtcgccgtcaggcggcatattcagattttgggcagcctcaggcgtgggttttctcacttccagcgctaataatttggaagtgacattaaaatcttcaagtgattctttaaatccctgattagaaagcagactgatatacccttttcttttattccgtctgacaaaaatgccgcttcccctcacttgaaacacaatcccctttttttctaataaatctaaggacttggtgatcgtgcttttgctcacgttaaaccggctcattaaggtttgcagcacaggcagtttatccccttgctgcagctgatgttcttctatgtatttttcaatatctatcgcgatttgctggtattttaacatatacattcctcattcatttattgtcccgcttctttcagaattatagcataatcgtttttaaaagccatttcgtaaattaactataattgtttatgtattgataaattataccggtacaattataatgaaaacgtataatatgaaaataaaggcaggcattcttctgcacttgcgaagcggatgcttgaagcggctgcagtgcatttattcggcatgcaagcggcagtcaaataaaggaggatataaacgatggggacattgccaaaagattttttatggggaggcgctctggccgcccaccaatttgaagggggatggaataaaggcggcaagggaccgagtgtagtggacgtcatgacggcaggcgcgcatggtgtgccccggaaaataacagatacaattgaagagcgggaattttatccgaatcatgaagcgatcgatttttatcatcgttataaagaggacatcgcattattcagcgagctgggtctgaattgtttaagaacgtccatcggctggagcagaatttttcctaaaggtgatgaagccgagcccaatgaggaaggattggctttttacgaccgggtgtttgatgaattgctgaaacatgggattgaaccggtaatcacgctgtcacattttgagatgccgctgcatttggcgagagaatacggcggtttcagaaacagaaaaacagtcggattttttgtaaaattcgctgaagtgtgttttgaacgctataaacataaggtgaagtattggatgacgtttaacgaaatcaataataagatggatgtgaataatccgatctttttatggacgaactcaggcgtcgccgtcaaagaaaacgaaaacgcaaaagaagtcatgtatcaggccggccatcacgaactgctggcaagcgcattggctgtttcgaagggaagagaaatcaatcctgagttcaggatcggcgcgatggtatcacatgttccgatttacccgtactcatctcaccccgacgatgtgatgctggctgaagaaacgatgagacagcgttttttcttcccggacgtgcaggttcgcggatattatccaagctatgcgttaaaagagtttgaaagagaaggctatcagatacactttgaagacggtgatgaagagattttgaaaaacggccgagtggactacctcggattcagctattacatgtctacaaccgtaaaaagtgatgtatcaaacgataataccggagatgtcgtaaacggaggattgccaaacggcgtggaaaatccttatattacagcgagtgattggggctgggcgattgacccgaccggtttacggtacacattaaaccgcttatacgaccgctaccagattccattatttatcgtggaaaacggattcggcgccatcgacacattagaagaggacggttcaattcatgacactccaagaattgaatatttatcgtcacatataaaagctttgaaaagagcaatcacatatgatggtgtggatgtaatgggctatacaccatggggaattattgatatcgtgtcatttacaaccggagaaatgaaaaaacgctacggcatgatttatgttgatcgggataatgaaggcaacggttcaatgaggcggcttaagaaagactcatttgaatggtataaaaaagtgattgaaacaaacggctcatatgtatcttaaaggtgtaaaaagggaaggcttcaccgttgtgtgaagccggctttttatcagtaattttgaaagcgcattcattcaagcgggaaggaggtgactgtccggctattcaattagaatcgcttataaaaataaggaaagggatggtggttcatgttttttaaaaaaggtctgcacataacgctggtttttcttatgtttttctttttcatatcaagcagcatggaaaccgaagtgtatgcagctgatcggaaggcttcagacaaaaacaaagtaagggtgtggttcagttctgaaaaagatccggcttcccgtacgtggtatgacgggccgctagaagtgaaatacgccttagacgaacaaacaccgcttacattgacaaaaaagaaggcttctgactccgccgctgtgtatattgatccgtcgcgccgctatcaaagtgtgttaggcgtaggatcgtccctggaagaatccacaatccataatttatcaaaaatgacacccgcaaaaagaaaagaagtgctgaaaaaactcgttgatcccaaagatggtatcggaatggacgttatgcgcataacgatcgggacatctgattttacagcacaggaattttatacgtatgacgatatgcctgaaggccaaacagatcctaagctccgtcatttctcgatccaaaaggatattgatttacacattacagcaaccatcaaggaagcgctggcgataaatccggaactgaaaatcattgcctcaccgtggagcccgccggcttggatgaaaacgaatgaaaacctcaagcggggaaagctgaaagataaatatatcggcacactggccgtttacttccgcaaatttattgaggcgtacgaaaagcaaggaattccgatttatgcgctgacccttcaaaatgaacctttgctggaaatcgactatccgagcatgtatatgccgccgtctcagcagcgtaaactggcactggccttaaaaaaagaaatgaaacaacacgtaattgacacgaaaatttggatttatgatcacaatgcgagcggggcgtggaactatattccgccgattttagatgataaaaaaggaaaccgggcggcagacggcatcgcttttcacgattatgacggtgacctttccgtcatgtcggaaatcggaaagagatatcctgataaatctattcacttaacggagcggtctgtctgggggacggcaggggcggaccggatcgcgcagtatttccgcaatggcgcgtcgagctacaatgcgtgggtgacgatgctcgacagtcaaatcaagacgcatcattggataggcaccccagacccgacgctgtttattcaggatgctaaaaaccctgaccgctattggaatatcccgatctttcatatgacaggcaacttttcaaaatttatcgaccggggagcaaagcggatagaaagtaattacggctccaaaaacacagtctcgaatgtatcgttccttaatcctgatcaatccattgtgacagtcgtaatcaaccagacatcttcagaacaaaaattccatgtcgtttcagaaaatcagcagtttgaagctgtcatcccagctaaaactgtggctacctacaaatggaagtgaaaaaagtaaaaaaccggcacatttacgtgccggcttctttctgttaagcgcctttttggttcagttgatcagaaggcgctttattgaataaaccgtctttgacggcgtttgaagccgctttttttacaaaaaacgggttgaggataataacggctgccatgttagcggtcaaaccccaaaagccttcatatataccgtgggcggattgggtgatatttaccgtgaatgtcacgataagaccgacgagaagaccgataattgtcgcttctttcgtttgattcttccaaaacagactgacggcgatagccggaaagatctgaaccatgccggaaacaccgagaagctgaagggtaacgagcgcggtcgggaacagcatgccgaataaaagcgcgagtccgatgacgacaaataccattgaacgggtgatcatcgtcagcttgcttggtgacacattcgggtgaatcaaatcccgatataagttattcgcaaataagtttgatgctccgatggccatgatagagcagggaatcaatgacgcaagggcaatcgtggagtaagcaaagccctgcgcgactccgccgtaagacgtttgaatcagcttcaataaagcaagccgcggattggtatcttccggcaggacaagaaacgcgataaagccgagaaaaataacaagaatcaaaacaatattataaagcggcagaaacatgctgtttttgcggacggcatctgcgctttttgccgtaaatacgccggttgccgcatgcgcccacataaagagcgccagcgcagatacgatggaagctgtgataaaccaaggaattcctttcggccccgagtccggaatcgtcagcatttgcggcgctttttcagccaaagtgtgaatcatcggcgtccagccgtgaaaatggatcagcgggagtgacacgaccataaacagcataatcacccacacgagaatgtctttaataatcgccgtaaacgtcggccctttaattccgctgaaaaaagtataaagcgctacaagaataaaagagatgatgacgaccatattgacattaatgacacccgttccggccacctgaagcgtatcttgaattccgctcagctggagacaaatataaggaatgagcataagaacgccgacaatggcgacaagactggccaaaagtttactgtcaaaacgctcacgggcataatcggcaagcgtcgttaatttgtgtatttttgccactttccacaactttggcagaaagaaataagcgataaaatacgccaaaacagaatacgggattgcaaaaaaagcaacgcttccccctgtgtaggctgtgcttgttaagcctaaaaacgtataagccgtatagagatccgcgccgactaaaaaccagacgaggagccccccgaaccgtctgccgccgacagaccattcctcaacagaagtgcgtgatgatttgtctctcccggctataaagccgatacagacaacggttaaaacgatgacggctgtaatgatcaatgctgttatatttgcgggcatcagtccagtcctccttgtttcttctgcagcctataaataagaaacgaacataatggagtgactgcgatccataaaagcagccagaaatgaaaaaaaggcagcccgataatgatcggatgaacccgattagcggctgacagcagggccagctggctgaaagggattaagatgagaacgaaaattagtgcttttctgaccatttactttcctcctgaaacttgataatgctccttatcatagcaggtgtcagataagatcacaagatatttttcagaaaaaaaagaattctattgcttttttaactgaaacactttagttgcatcttcattcatattaaattaaaatagttaatatctcgaaatcaagatatttaggagtgaatacattgaatacacaaggattgcaccatgttaccgcatttgcaaaagatcctgctgaaaatcttcggttttatactgaagtgctgggtttgcggctcgttaaaaaaaccgttaattttgacgacccggccacttatcacttctatttcggcaaccaaaacggagagccgggcacgatcattacattttttccttttcagggaagccgcccgggaaccgtgggaaaagggcaggccggaagaatttatttctccgtgccgaaaggagcactcgcgttttggaagtgccggcttgaagaaaacggcttatctgtaaaagaacagatcatgctgtctgaacaagtgcttctctttaatgatacagaagacctgccgcttgccataatggaagatgaaagaagcggacagagtgaatggactcctgcgggcattactgaaaaagaagcgatcacaggcatgagaggtgttcttctgtactcgtaccgtcctgaagcaaccattcaatttctcatagaacgcttcggttattcaaagacaggagaagaacagcagattgtcaggctgcaatcggaggcgcggatcggacatattattgatgttgaccttgcgccgaaagaagcaggtgtcggcggttacgggacggttcatcatgtcgctttccgcactagcaaaaaagagcaggcggagtggaaggatattcttgctgattctcatcttgattcatctgacattcttgacaggtcttactttacatcaatctatttcagggaaagcggcggcattttatttgaaatggcaaccgatgaaccgggctttatgacggatgaatcctttgaaaatctcggaacagagctgaagcttccggaatggctggaagagcatcgcagccagattacagctgttttgcccaaaatggagaaaggagaatgatgatgaaacatgtgtttgaacagggaacgtcagaaaatgttctgctgcttttgcacggaacgggaggaaatgaacatgatcttctgtcgctcggacgttttatcgatccgaacgcaagtctgctcggggtcagaggatcagtgtcggaaaacggcatgccccgtttttttaagcggctgaaagaaggcgtatttgacgagaaagatttaattgaacggacggaagaattaaagaattttattgatgaagcggcgcaaatgtacggattcagcagagaaaacgtgattgctgccggctattcaaacggcgccaatattgcagcaagtcttttgtttcattataaagatgtactgaaaggagctgttctgcatcatccgatggtgccgatacgcggagtgaagctgcctgatatggaagggatgcctgtgtttatcggtgcaggaaaacgcgatcctctatgtacaaaagaagaatcggaggagctttatcagtatctgacagatgcccatgcatccgtttctcttgtttggcaggagggcggtcatcagctcacacagcaggaagcagagcaggcacgaacctggtacagtgagcgattcctataaaaaacccttagtccgcttaagcggactaagggtttctttcatcttacagccaagttgacactttagatacaggcagccggttgcttttatgcgccggcttaacggctttaccgattgaaatcagcatgacgggcacgaaacgctcgctcacgtcgaattccttaacgaattgctctttattgaatccgccgatcgcgcaagtgtcgtagccttttgctttagcggcaagcatcagttgcatcgctgctaaagaagcgtttaaaaatgctgaatcacgggcaaactgatcattttggtatgcaccgttaatctggcctaaaagcgtttgtttaatctcttctgtgatattgccttgctcagccagttcagcataaacgtcttcaccattttcatttgcttttaaatcgcctaatacggcaataactgctgatgaatcaataatctgtttttgattaaaagcaaccggaagcagggcagcttttgcttcatcactgtgaaagacttgaaaatgccaatgctgaaggttccaggcggaaggcgcttgcgttgtgatttcaaggagttctgttaattcctcttttgtaatgaccgcgtctttatcgtattctttaacagatgcgcgttcctttaaaacgtctaatacggatgtcatcatgtttcctccttcggataaacgtgttatcataatagaaaagttagaagcttactaaatgtaactcgaaaactaattttaatggatcacaaaaaacttgtcaattcatagatgaagggatgaactcacgtgggatatacaatgtgtcctaaaatggaatccgctttttcccttttgggaaagcgctggaacggcctcattatccatgtactgatggacgggccgaaacgatttaaagatatgaccgaaacgataccgacaatcagccaaaaaatgctcgcggagcggctcaaagagctggaacaaaatgaaatcgtcgagcgtcaggtgctgcctgaaacacctgtcaaagtcatttataaactgactgataaaggcttggccctgcaagccgtttttcaggaaatgcaaaaatgggcagacagtttttgcgagcccgggggatctgccaacgacacatgtgatgaataacaaaggctgcccaaggcagccttttcttaatgatcatgtttactcttcataaaaaccattaatatcaaaattgttcagattgaggttcaagccttttaattgctttaataaagcatcgaatgtaaggaaatgatcatttttacattccgccgggacatcatttggagaaaatagtttcattcctccctcaatccactgtttccggtataactgaaatgccgcttcaattaaatgatcaggcgttacaataaaccctaagcttatttcatggtcctcgctgtagccgaattcaaacccgcagcaggggcaaatatcaaatgttttttgatattcgccgttataaacgggacttgtctctaatcctttaaatccgcatatcaaacaagggtacaactcactaaccaacatacatccctcttttattcagtttgcaatcattcagaacaagcggggaggccttttacagtttcccggttaaaaactgagcctcaccaagcccgaagctccaatcggcgttcccgttttctgtaatggaaatcatgatgtcctcgggtgatatgccgcattctgttttaagctgatcagccatcagttgatataacgtttctttttgatgttcggtgcgcgctttgctgacaatgctgatgatgacaagatctttgcttcttttgaaaccgagcccggtatcttcaatgataagctcatgaggccgatgctggtgaacgatctgataacggtccgttacagggacgtcaaaagctttaaccatggcgtaatgggcggtatccagtaatttttttaatgctgcgtcatcccggccttcaataacgtcaaaacgaagtaatggcatattttattccccctgatggttttttatcatgtcgcaacttgtaaaaaagtataacagttaatcaaaatgtaatcaaattataaccaaaatatttatacattaatgcaatatcacagagaggcacatgttgttacaatcgcccaatcaatttcctcattttatgaatacgcttaagaataggcagacataaaggaggaaaaacatgtaccctcgtcatgcattgtatcgcgggaatttcggtcctgccggatttccggcgagaagtccttttttgttcggcgctcctttattcggcggatttttaggcggtcttctcggaggcgtgattgccacaggctttacaagaccccgctatccgtacgggttcgccggttacggatacggaggcgtcccatacggcggtttcgggccgggagccggcggttatccgccattttattaaagaaaaaacggcctgcatcgcgcgggccgtttttttatcttaaaatctccacttccgatagattgtagtcttcctgttttgaaaacataacttcaatcatcccgtctttatagactgcttttgttcctttccgtttgacgaggctcggaaggacgatttctttttttccttctcccagactgctgttctctacaacgaggctgtgtgacgtatgcttaatcctgatacggtcgagttcctcttgttctgcgggaattttcgcaaaaacatgatcggatgtttcaaaaaggtcaatttccggcttgggcggctccgcttcgaccggatcggcctttttggacattgggtcgcgaaaagggaactgtccggcataaccggcgccgaatacgctttccatcactcggttgacatatgtctcgacatctttcggatcagcatttttaaacgtttctttagagaactgattttggaagggaaaatatctgttccaatcaaacacggcatctcaccctttcttaacggacaacatagtatatgcccgccggaagcttcccgtgatataatataatctgtttacagaaaggaaggggaaagccgtgcaagggaataacgcaagaaaaggaatcatttataccgcttgttctttcgtcatgtgggggctgtttccggtctattggaaacttcttgaacaaatacccgcattggatattttagctcaccggattttatggtcatttgttttcatgtgtgtgcttttaactgtgcttaagaagtggaaaaccggatggcgtgaactgcgtcttttgaaatcggaagggggcctgctggcgctttttttcgcttccgttttaatttccgttaattggtttgtgtacatatgggccgtcaatcacggctttttgcttgaagcaagtctcgggtactacattaatccgctcgtttccgttcttttgggcatcctattcttaaaagaaaagcttaacaagatgcaaacagcagccgtttctattgccggggcggccgtgatcatatctgcgtttcaatatggcgcggttccttatatcgcattgctgcttgcattcagcttcggcctgtacggcttatgtaaaaaaagaacccgcatgtccagcacgatcggactgacgctggagacgcttttgattaccccggctgcacttatttatttaggatatacagctgacgggagcacttccgggtccttgggggcaggaacatgggcgctcctatttttcgcaggcgtatttacggccctgccgctgttgctgtttgcagagggggcaaagcgtctgccgctgtatcaagtcggcattttgcaatatatagcgccgaccattacccttatgctcggcgtatttgtgtatcatgaaccgttttccgggcaaaaagcgtttaccttcatttgtatatgggcagcattgcttttgtttaccttttcacagataaaatggaagcggccgataaaaagccgctaagcctttcgctttccagcgatagcttaaattatgtataatcattacgagtatgtaaaggagctgtacaatgggcactgataaagacatagcaaaagcctatcaggcactgtggaataaccgcactctcccggcttcaactcttgaagaagcggagaaggcaattgatcttgaactgcttgatcaaagaacacatccgaggctccggaagtcacccgaggaaaagtttgctctggcggtgcagcgaattgtagattcccggctgcggccgattgagaaatatgaattggttgaactacatacgaagcgtttgcaatttttaaaagaagaaagaggggagcagctatgaaagcgatcataaaagaagatgtgcaaacttctttagagcgatatgccgatcgtcctgtatatatccatttggaaacaacgaccggttcttattcagcgcatctgaatgagaaaaacatgacggttgtagcctatatacgcaatgcaaaagtgacgtaccatcaggcgaaaatcaaaggaaacggcccgtaccgcgtcggtttgaaaacggaagaaggctggatttacgcagaaggtctgactgaatatacagtagatgacgaaaaccgcttgttaatggcagggcatctgccgggcggaaaattggcgatttcgcttcaaatcagcgaaaagccgtttacagtttaaagaaaagggtgaaaatcatgaaagaacatgtactcgtcatcctgcctcaccctgatgatgaatcatacggagtggcagggctgattgctttacacagacaaaaagatattcccgttacgtatgcatgcgcaacgcttggcgaaatgggccggaacatgggagatccttttttcgcgaaccgtgaaacactgccgctgttaagaaaacaagagctgatcgacgcatgcaaagcaatggacgttactgacctgagaatgctcgggcttcgtgataaaacacttgaatttgaagatgacgagtggctcgctgatatgatggaagagattatcgacgatgtaaaaccgagtctgattgtcacattctatccggagcacggcgtccatccggatcatgatgcatgcggcgaagcggttatcagagcgctttacagaaagaaaaaagaggaccgcccgcgcacgctttgcatggcaatcacccgcaacagggaggaagccgtcggcaagcctgatgttattcttgatattaaagaggttgccgatattaaaatgaatgccttaaaagcgcaccgcacccaaacggaaggcatgctgagagagctggaagaaaaaataaaaaataacgagccggttcttcagacatggtttgaagaagaagtgtattggacatatccgtggaaagactgataaaaaaagggataaggctgaaatgccttatccctttttttgtgtcagatcggaagcgatcgcttctgcaagcgaagaccttattgataaatttgaaaaactcagtcccagctgcactgcggtttgggcgatttcaggacggattccggataatgtcgctttcacgccgagcattccgagtgattcaattaaggtgaaaagctgttgggcaaccatcgtatcaatcatggctacgcccgataaatcaatgtacagctgcgtgatgcgcttctctgaacactggtgcagcgtattctccaaaatcattttggctcttgccgtgtcaatatccccgatcagcggcagcagtccgacattgtcaaaaagcacaattaccggcgagctcagctcggtaatcaattctttttgcgcttcaagctgaatgtttgtgtttttatacatttcctctatgaaaatatgaatgaccacatcaaaagatttaatcagcgtatggaatatatcttcggcatcttcttctgtcacggtgtctgaatgaagtctggtaaactgcttgacatggccgacatacaaatcacgaactctgataaactcgcgaataatataatggatgggagtttttaaatgttctttatcccgtgcggcttcaaacgcccacttttccaatgccgctgtatatacttccttctcttcagaaaaaatccgattgagttgataattaaacgccagattttgttttttcagatttgtgagtacagccgggtcagtagaagcataaacagaatcaggatccgtttcatgaagcgtatcaaaccatgtctgactgatgtcctccgcccgttcagttaaataatcgtacagcagtttatgttttggcattgctgctcctcctttataaaatcgtcatttttttcacataacgcttttgcagcttcatcagtctgaagaataaaccgacagctcctgcggcaagtcccgcaattaaaccgatccagtagccgtatgccccgaggcccgtataagtgccgactgcgtaaccgaccggaagcccgataatccaatacgacacaaaagccgcgccgagtgtataattgacatccttatatcctctcagagcgccttgtatcggagctgctacggcatcagaaagctggaaaaacagcgcatagattaaaaagtgctgcgtcaacatgagcaccgccggatctgatgtatacattccggcgatttgcggtctgaacagcaaaatgaaagccgccgtgcataaagaaaaactaagcgccatcacgatcccgatatagctgtatgagcgggcatccctgtagcgctttgcgcctgcttcaaagccgaccaaaatggtcatggccatggatacgctgagcggcagcatatacaagagggaagcaaaattcattgccgcttggtgggctgcaatcgtcaccgtctgaaaatggctcataagcagtgtgacagccgcaaaaatgctcgtttcaaaaaataccgcaaaaccgataggcaatccgattttcaaaagcttcctgcattcagtcggagaaaaacggtacagtttccgaaatacagagtacccggcaaacggctcaaatctgcagacgataaaaaagctgatggcgcaaatacaccagtaagtcagggcggaagcgagccccgccccgactcctcccaatgccggcatgttgaatttcccgaaaataaatacataatttaaaacaaaattaataggcaatgagcaaagcgtaataagcatagtgactcgcgttttgccgagtgcatcaataaacgagcgcaaaacggtgtacacaaacaaaggaaaaataccgagggataaaaatcctaaaaagtgtttggcgatcgtccggacacgaggttccaggcccaaatgtcccaagatcatatcaacggtgaaaaagccgatcaggataaccgccgcactgagaacggccgctacataaacggcctggatgacggaaaacggcacttccttttgtctgccggctccaaacagctgcgaaacaacgggcgtaacggccattaatattcctgccaggcccgtataaaccggcgtccacaggcttgaaccgattgcaaccccggctaaatcggcagcgctcactttccctgacatcaccgtatccaaaaaggtgatcagggaaaggcccgcctgtgtgattaaaatcggaatgaagatatgtaacagctgtctgaccttttggccgatcgtgttcgtttctctcaagttaggttccccgtttctttattttaacgagagaaattataacattttatgtataaaaagcaatgaaagccggcctactcttttttgtccggtttcggctttttaaacatcttggcataaatgaatgaaagtgaaatgacccctaaaaaggtgcagatatattgcatcagccgtgcgaattccatatgatgtgcgcctcctttcatgattatggtgcacacagcggcgcatatccatgcgcgcgatgcagaaaataagggaaaggagctgatgtgacatgcgccacactcaaatgacggaaagcgcgtttaccgctgccgttcaaacgtatttgaaacaaattacggaggatgccggaatgatactgcggacattggatgaaaaagaccaatgccttctttgcgaattagatgaactgggacatacgtttcaggaaatgcaggctgtcgcttcgtcgttttacctgcagtcatatatcgaacactttacgccttcctatacagagctggcgagggccgtgcagcatctggcggaagaaaaacacggagcgctgattgtgattgaacgtgcagatccgctggacggaatgatacaaaaagggaccagcctgcatgccgagatcagtgcagctttaattgagagtattttttatcccggcaatccgcttcatgacggagccgtattggtcagagaaaaccgggttgtatcagcagccaatgtgctcccgctcacaacaaaacatgtcgatctcaaatacgggacgcgccacagggccgcgatgggactttcggccgtgactgatgcactcgtgctcgttgtttcagaagaaacgggaaaaatgtcctttgctaaagacggcggactgtatccgcttgtttcgccgcgggcgcttcatacgaaataataagaaaatgggaatattgtacccatttaatattaataaggtgaacatctttacctttttctgtattgatgttatcgtttaaatatacataaaatttaaaagaatagggagtggaaagatggcaaatgtattgatgatcggctttccgggagaaggccatatcaatccgtctttaggcgtcgtaaaagaactgaaggcaaaaggggaacatgtcgtatattacggcgtgaaggaatatgagaacaaaatcgcgtcaagcggagcggaattccgtgaatatgaagatttccgaaaagatgaattcggaaaaaatgcaacgggtgatgaacagcgggacgctaccgagtttttgctattaatgattgagacttccaaaaaagccgcactccgtattcttgaggaagtaaaagatgaatcctacgactacatcctgtatgatcatcattttctggcaggaaggctcgtgagaaaccagctgaaactgccggcatattcactttgtacgacatttgcaatgaatgaagcatttattaaagaagtgttttcaaatacaaaccttgtatcagaggaatcatctcattatccggcttataccgaagcggtcagccggctcaatgaagaattcagcgcagacattaaaacgccgtatgatattttctcaaatgacggcagaaaaaccatcgtatttacttcaagagcgtttcagccgaaagaagaagagtttggcgattcttatctctttgtcggtccgtccataaccgaaagggcggcggctcaagatttcccgtttgaacagcttgaaggagaaaaagtcctgtttatttccatgggtacgatttttaacaatcagaaggaattgtttaataaatgcttaaaagcggtcagaaactttaacggaaaagccgtcatgtcaatcggcaaacatcttgatccggcggagcttgatgaaattcctgagaatgtcattgtcaagccttatgttccgcagcttgagatcctgaagagagcagacttatttatcactcacggcgggatgaacagtacgagcgaagggctttactacaaaaccccgatgattgtcattccgatgggcgcagatcagttcgccgtcggaagccaagtggaaaacacgggcgcgggcaaaatgtttaaaaaagaagatgtaacagcggaactgctcactgaagcaataaaagaattgagcgaaaatcctgaatatcagacaaaagcttctgaaatcggagaatccctgaaagcggccggcggagcacagcgtgcagcggaattgatagcagaagacgtgaaaactgccgagacccgggttctgtaatcagccgtcacccgcttcctttaaaggaagcgggctttttttgattgtttttcgggaggatttttcacgccataaagagaattgtatgaaaaacagacaagaaaggtggaatgtcgcggaaaaaagccatgttatgaaaatgattccaaagtcttttgtgaaatgttctcaatttatgtaaaatgtgtggcattggtgatgatctaaggccaaatgaatcggaattaatgtcgacttatgaatgaatcctgaataacaggcggcgtccaaagaaaaggaacgtccctttcagcaatgataaataggaggtttttcgttatatgaagaaaaaaatcgcagccggactggctgtatctgcagtaatgacttcaaccttcgccgtgcatcccgctgaagcaaaaaccattcaagtaaaaagcggcgactctctttggaagctttcccggcaatatcatacaagtatttcagccctgcaggcggaaaataaactgaaatcaacgatactccacccaggacagcggctgcacattcctgacggcagcggcaaaacggggcaaaagggaaaacgaagcacgggtgcttacacagttacatacggcgactcattatgggtaatcgcaaaaaaatacaaaatgagcgtttctgagctgagaagcctgaaccgtttgagttcagatgtcatctatccgggccagaaactgaaaattaaagggtctgccggcggcacggacggaggcggcagacagacaaagcctgataaaggcgcatcagggacttacactgtgaagccgggtgactcgctgtggaaaatcgccaatcaaaccggcatcaccatcgccgaactgaaaaagctgaatcaattaacatcagacatgctgtatccgaatcaagtgttaaagatcaaaggttcttcacataacggaaacagcggcacaacaccgccatctcattcaaatccttctgagaagccatccacttacaaagtaaaagcaggcgattccctctggaaaattgctaatcggttcggcatcaccgctcagctcatcagagaaaaaaataaattgacaactgatgtgcttcaaatcggacaagttctggtgattaacggaacgggaaaaacagaagatcctgtgcggcagccggataacaaaccggcaaaaccaaacaagccgaatactcccgaacctccggtgacagggtcaaagattgacagaatgataggcgaggcgaaaaaacatgtcggcgtgccttaccgctggggaggcaatacgcctgcgggcttcgattgcagcggttacatctattaccttttaaataaggtaagctctgtttcccgtctgagcacggccggatattggaatacgatgaaacatatcagccagccgtcagcaggcgactttgtcttctttacgacatataaagcgggcccttctcatatgggaatgtatttaggcggaggagattttattcacgcaagctcctccggggttgaagtttcaaacttaagcaatccgtattggaaaaaagcttatttaggagcgcgcagttatttttaaaaaaagcctttcggggctttttttgtttaccatttttacgttttgacaagactgatgggtaaaaaataagggggaggaagcatgaatcgtctcttgctttttctcatgctcgcatcaattacgctttgcggctgcgctcctgttccgcccaaaaaacatggggaaagccgcgcattggaagcatctgcataccgtgagcatgccggactcatcaatcaaaacggaaaaacgatcggatatatcgaagtgagggaatctgatgatgaagggtcagacattcatatatcagcggggcatctgccgcccggcacttctctcgggtttcatatttatgaaaaagggacatgtcaggcacctgatttcgaatcagccggcggtccgttcaaccctttgaacaaagaacacggcttcaacaatccgatgggtcatcacgccggggatctccccaatcttgaagtgggggctgacggtaaagtggatgtcattatgaacgcgccgcaaacttcattaaaagaagggagcagactcagcctgctcgaccgggacggaagcgcgttcgtcattcatgaacatacggacgattatttgacaaacccgagcggaaattccggagccagaatcgcctgcgctcccctgacaaaaagcgcccgcagggaatgagcccttttgtattgagtatacaagggcttttttagtatactcggttatggaatacaaatggaaaggaaacaccacctatgacttcagaattacagcacctatcacttccggaagatatacaaaacaaactgcaggcttatcaaaatcatcccgtttcccaagaattccgggatttaatcggatcatcaggctatgaggccgaagataaagcgattgtattcgatgccgtcattgctttgacaatgggaaaaaatatcttattaaaaggaccgacgggttcagggaaaacaaaattggcggaaacgctttcgaactattttcataaaccgatgcacagcgtcaactgctccgtagacctcgatgcagaagcgcttgtcggctataaaacgattgaaaatgaacagggacaggcgacaattgaattcgttcccggacctgtaacaaccgcaatgaacaagggacattttttatacattgacgaaatcaatatggcaaagcctgaaacccttccgattctaaacggcgtgctagattacagaaaaatgatgacaaatccctttacaggagaagtgattaaggcaagcgaaggattcggtgttatcgccgcgattaatgaaggctacgtcggcaccgttccgctgaacgaagcccttaaaaaccgttttgtcatcattgatgttccgtatattaaaggaagcctcctgaaacaggtgctgacctctcagtctgtcttaaaagatgagaaattaattgagcgttttatgacgctgtcttctgatttaatcgcacaagcgcataacggacaagtgtcagaagaagcggcgtccatcagggctctcattgatacgtgcgacttggctgcgtacatcccgccgaaacgggcgattgaaagaggcatcgtagaaaaacttgacgatgacagggaaaaagccgctgtcagaaatattgcagaaacgctgttcgaatgagggatatacaatgaagtttatcaaatttaacgacagcacgattgattcgtttttgttcatgatgctgactgacctggccaaaacactgaccagaagcagtgaagttgaagtggaatacggcgtgcagtcttactacaatccctttgaaaagaaaatttatatgagccacttttggaaagaccgatcagccggggatatggaagccggcctgaaaagcgatgtctatttgcgcgctgtcggaacacgcagcagctcatttcgggaatttgcggggtttttaaatgacgttcaccggcatttcacccgccaaagctttgccaagcagctgtttatgctgcttgaggatatcagaattgaagagctgaccaaaaaagaacggccgggaacgaaacgtgtttttcagaagcggagggagatgtacaggaaatatttcacgacgcagctgacattgaatttagaacggagcattttcaccgacgctttgtattgcgcgatgtttgtcaagctgacggctgagtctccgcttgaaggcattccttccatgcatgaacatattgatatgatgataccgtatattgaacgtcagctcatccgggtgtatgaggcggattctacggaacaaatcgcaagaataacggaagacctcatggaaggccttgatgaagtgcttgagaaagatatgctgaacacgtacttttttctgccggaacttgattacgaaaaagcggctgaagagcctttattcgaaagtgtaaaaaaagcgccttcgttaagtgacgatctcacgctacctgagtcttccgacggagatgaagaaatctttgaagagaaaatgaatacgtggcaccgggaaaccgaagcgccggcaaaaagtttccttcaatttgatattgagcacggcgcgaaatcggatcttgggaaagacgcggccagagaaggcgatgacggtgaccaggcgctcggctccgttcaaggttccgcacgtcagacgaaaagagaggattactccaaactggaagcgcttgaatccattcaggatgaacatgagggcgcggggctggctgacggaaaagaaaacaaatttgccttcccggtttatcaaacgcctcataaagcgtctcctgaagaggagcagtcttataaagaacaggcaaaaacgatagaatcatatcaaaaacgcttgaagcagatgatacaaaaaacacttgagcacaaaaaaacgctcccgcggaccgaccttcacgcaggccggctgaatcgcaaactgatccgctattttacggagcggaacccgcgccttttctataaaaagcaggacccgtcttcagacattgacgcggtttttacattgcttgtcgattgttcggccagcatgttcgacaaaatggatgaaacaaaaagagggatcgttctttttcatgaagctttgaaatcagtgtccgtaccgcaccagatcgtcggattttgggaggatacaaacgaagcgaccgaaacgagccagccgaatttcttcaataccgtcattccgtttgaagagtcgctgctgcaggcggcgggtccgctaatcatgcagcttgcgcctgaagaagataacagagacggatacgccatcagacaaatgacgaaacagctgatgcggcggagtgaggcgcaaaaatttttaatcgtgttttcagacggagagccggcagcattcggatacgaacaaaacggcatcgtcgatacgagcgaggctgtcatcgaagcgagaaaaaaagggatagaagtcataaatgtttttctgtccaatactgcaatagaggaatcacagatgaaaaccattcaggatatgtacggaaagtacagtatttttgttccggatgtcgatcagctgcccgatgtgctgtatccgctcttgaaaaaactgcttcataaaagcataggataggctttttcctatgctttttcgctttttattttaaaatgatttaattttttcggtattgatctgttttttttactattttgtgaacaatcaaggtagaatccaaacgcaatcagtggtaaaatatccttggaagcgtttttattacataattttgggcacagcgttcaaaagttatttcaagatagtgaattgatcacttgattatctaggttgggggtaatattcaaatgtttcaaaataatatgaaacaaagaatgaattgggaagatttttacggaccgaacctcggctacgcactggagctgtacgaccaatatgctgaagatccagacagcattgatccggatctgaaagacatgtttgacgaactcggcgctccgccaagccaaataaaagaggcatcgggaacaaaggaacagggacgcgtcaccgcagatctgattcaaaagatcgcagcagcagttaaacttgcagaagatattcgaacctatggccatctgaacgcttccgtcaatccgctcagaaaggatccgaaaaagagcgagctctttccgttatccgagtacgggcttacagaagaagaaatgaaagcaatacccgcgtctgtcatctgtaaggacgcacctgccaatataacaaacggcttagaagccatccagcatttacgcaatacctataaaagaaccatctccttcgagtttgaccatgtgcatgatttcgaagagcgcgcatggattacaaaaatggtcgaatccggagaactgttccggaaaaattcaccggaaaaactgtcagccgttttagaaagactgacggaagtagaaggatttgaacaatttttacaccggacattcgtcggtcagaagcgtttctcaattgagggattagacgcgcttgtgccggttcttgacgacattatcgcccagtctgtgaaagcgggcacaaccaatgtcaatatcgggatggcgcacagaggccgtttaaatgtgcttgcgcatgtgctcggcaaaccgtatgagattattttctcagaattccagcacgcgccgaataaagaccttgtgccgtctgaaggatcgaccggcatcagctacggctggacgggcgatgtaaaataccacctcggtgcagacagacagcttcaggatgctgaaaccaaaagcgcgcggattacgcttgcaaataacccgagccatttggaattcatcaatccgattgttgaaggaagcacgcgggcggcacaggaaacaagaacgcaaaaggggtacccggttcaagacgaaacaaaatcgctcgccattttaattcacggtgacgcagcgtttccgggagaaggcattgtcgccgagacgctgaacttaagctctctgaaaggctatcaggtcggcggggccattcatatcatcgccaataatatgatcggctttacaactgaaagcgatgaatcacgatccacgaaatatgccagtgatttggcgaagggctatgaaattccgatcgttcacgtcaacgcggatgatccggaagcatgcctgtcagccgttaaatttgcggttgaataccggaagcggttcaataaagatttcttaatcgatttaatcgggtacagacggtacggccacaatgaaatggatgagccgtcaacgacacagccgatgctgtatgacgccgtcagaaaacacccgactgtcaagcggatctttgcggaaaaactcgtaagtgaaggactgatcagcgaggaaaaagcgcaaaacatcgaaacgacagtgacaaaacgaattgaagacgcctataaaaaggtgcccgccaaaaaagaagacgccgtacgggaaattgaattgccggaaccggtgtccaacggttttccagacgttgacacagccattgattttgatgttctccgcaagctgaacggcgaacttatcaactggccggaatcttttaacgtgttcggcaagctgaaaagaatcctggaaagacgtgcaaaagcgtttgatgatgaccgtaaagttgaatggtcattggctgaatcgcttgcgtttgcttccattttgaaagacggcacgccgatccggctgaccggacaggattcagagcgcggaacgttcgctcaaagaaaccttgtgctgcatgacagcgaaacaggagaagaatttgttgccctccatcacttagacgactgcgctgcttcatttacggtgcataacagcccgctctctgaaggatcggttctcggctttgaatatggatacaacgtgtattcgcctgaaacgcttgtgatgtgggaggcgcagtacggggactttgccaatgcggctcaagtctattttgatcaattcatatctgcaggacgggcaaaatggggacaaaaatcaggactggtcatgctgctgcctcacggttacgaagggcagggccctgaacactccagcggccgcgtcgagcggttcctgcagctggcggcggaaaacaactggacggtggccaacctgacaagtgcggctcagtatttccatattttaagaagacaagcgaaaatgctgcttcgtgaggaaatccgcccgcttgtgatcatgacgccgaagagcctgctgcgcaacccgaatacggtatctgaagtgcaggaactgagcgaaagccgattcaagcctgtctatgagcagtccggtctttcccatgcttacgaaaaagtgactcgcgtcgtattatcaagcggaaaagtgtcaattgatatcagcgatcacttcaacaaaatggaaggcgataaggattggcttcatattgccagaatcgaacagctgtatccgttcccggcaaaagatacgaaggagcttttcgccaaactgccgaacctgcaagagatcgtttgggttcaggaagagccgcagaacatgggggcatggagttatatcagcccgtatctgacggaaatcgcgccaaaaggagtaaatgtccaatacatcggccgaagaagacgatccagtcccgcagaaggagatccgacagtccacaaaaaagaacaggaacgcattgtatctgatagcttgactcgcaaaaactaagggggaaatgaaaaaatggcggaaattaaggtacctgaattagcagaatcaatctcagaaggaacgatagcccaatggttaaagcagcccggtgattatgtagaacagggtgagtacttgcttgaactggagacggacaaagtaaatgttgaattgacagcagaagaatcgggtgttctaaaagaggtattgaaagattcgggtgataccgtccaagtaggagaaattatcggtaccattacagaaggcgctggcgaaagttctgcacccgccccttcagaaagtgctccagccaatgaacaaacgaaagaggaagcaaaagctgaacctgctgcacaagaagtcagccaggaagcacaatcagaagcgaaatccagaacggtagcgtctccggctgcacgcaagctggcaagggaaaaaggaattgatctatcacaaattccgacgggagacccgctcggccgcgtgcgcaaacaagatgtggaagcttatgaaaaaccggcttcaaaacctgcggcacagccgaaacagcaggctccaaaaacacagcaaagctttgacaaacctgtcgaagtgcaaaaaatgtcccgccgcagacagacgatcgcgaaacgattggttgaagtgcagcagacttctgcgatgctgactacatttaacgaagttgatatgacggccgttatgaatctaagaaaacgccgtaaagaccaattccttgagcaaaacgaagtaaaactcggtttcatgtcgttctttacaaaagccgtcgtggctgcattgaaaaaattcccgctccttaacgctgaaattcaaggcgatgagctgatcgtgaaaaaattctatgacatcggtattgctgtcgcggctgaagaagggcttgtcgtcccagtcgtgcgtgacgctgaccgcctgacgtttgccggcattgaaagagagatcggcgaacttgcgaagaaagcgcgaaacaataaattaacattaggtgagctgcaaggaggctccttcacgatcacaaacggaggtacattcggatcgcttatgtcaacaccgatcctaaacagccctcaggttgggatcttaggtatgcacaaaattcagctgcgcccaatagcgattgatgcggagcgctctgaaaaccgtccgatgatgtacatcgctttatcatacgatcacagaattgtagatggtaaagaagcggtcggattccttgtcaccattaaaaacctgcttgaagatccggaacagctgttgctggaaggataatttgagacagacaaaaagtacactgcccttacaagcagtgtactttttttattgagagaaggggagaatttatatgaaaagctgttatccgcttgagatcgaatttgaatataatgaagaattgcattctatcactccggttcttctgcaagacgaacatgacacgatattaatagactgcggatatcccggttttacaaaccatcttcaacatgccgctgcccggcatggaatgtcgcttcattcattgacaaaaatcattgtaacgcatcacgacatagaccatatcggctcactcgctgcattataccgtttacatccggatgtcagcgtgacagtacatgagcgtgaagcgccgtatattgacggctctaaaaaatctttacggcttgagcaggctgaatcaacgttttgttcattgccagaggatgcaaagccttatgcaaaacagttcatccgctctcttcaatcagtcgaatcggctccagttcaccggacagttactgacggcgagctgctgccttggtgcggaggcattcgcgttgtagccacgccgggtcatacacccggccatatcagtctttatctgcctgccgaaaaaactatggtcacaggtgatgcggtcgtcattgaagacggaaagctgaaccttgctaatcccggctatacgttacatatggatgatgcggtccgttctgtgcagcggctgctcgattatgatatccgccaattgatttgttatcatggaggtttatttcagggggatgtaaaaaaagcgcttttgcgtctgtttcgtgatctgcagaataaacaaggataggagcggcagcagcctatccttgttcagttatgaaaacggaatctttgccgtttcttcttcttcggcgctgtttttctcttttttcttagaccagtaggtggcaagaacagaccccgacagattgtgccatatgctgaaaattgcgctcggcacggctgacaaaggggagaaatgcgctgtcgcaagcgctgcgcccagtccggagttttgcattccgacttcgatcgcaatcgctttttgtgaagcataatccattttgaacagctttgcagtcaggaatcctaacaaatatccgattccgttatgtaagatgacgacagacacaatcagcagtcctgattgaagcacatgctcacgatttacgctgacgacagaggatacaatcgctacgatgccgattaccgacacgagaggaagcgcgtgcacggcttgtccgacctgttttttgaagaacagcttcacaatcaccccgaggacgatcggcaaaagcacggcttgcataatggaaacaaacagtgagccgaaagaaacggggagccactctttcgcaaacagcataataagtgccggcgttacaataggagcaagcaatgttgagatcgtggtgaccgcaacagaaagcgccgtattgcctttcgccaaaaacgtcatgacgtttgatgccgtaccgcccggacagcatccgaccagaatgacgcccgcggcgatttctgcggggaggcggagcccgattgataaacagaaagccgtaagcggcataatcgtaaactgggcagcgactccgatcacgacatgccaaggctttctgattaattctttaaaatcgtctgcttgaagagtaagccccatcccaaacataataataccaaggaaaatcgtcatataagaactgatccaagaaaacaaatcagggcaggcgaatcctaaaccggcaaagacgataacccacaagccaaaggtttggcccgcaaacctgcttatttttttcagccattccataaacacagctccttttacattcaatcaatcagtcagaaaatatgactgacttttctgtattccattataaataattttctgaataattcaatattaaatataagttttcaataaaattattatgtaaactaacatcttcttgactattcagacatatattcttacaattgatttttatactgaaatgaattgggagtgctgaagtgaaagaagctaatcaatggtcatctaagctgggatttattttagctacggccggctctgcaatcgggctcggcgcaatatggaagttcccttacgtagcgggaaccagcggaggcggcgcttttctgcttgtttttattttatttactgttttaatcggactgccgcttttgcttgctgaatttattatcggcagaaaaacacaaaaaaacgccgttgaatcctataaggcgctcgcgccggggaaaaagtggcactggatcggatatctcggaatcattacgtgttttattctattatccttctacagcgtagtggggggatggatattaatctacattataaaaggctttacaggcggcttatcgctttcttcgggatttgatacgttatttatcgataccatttcaaatccttatgcagccgttttcggccagctgctgtttatcgtgctgacgattttagttgtggcaaaaggggtgagcagcggaatcgaaaaggtaagccaggtgctgatgccggctctgtttattctgtttattctcttaatgatccgctccgttacgctgcatgatgcagcaaaaggattaaaattcttttttatgcctgattttggcgcgatggatgccaataccattttatatgcgatgggacaatcatttttctcgttaagcgtcggagtgtccgtaatggttacatacagcgcatatttagaaaaagaagaaaatattgttcaatccgccgtatcggtgacggtattaaatgtccttgttgctgtgatggcgggagtggcgatttttccggcggtgtttgcattcggcctcaagccggatcaaggcccgcagcttttatttaacgtgctgccgaccgtctttaaccaaatgccgttgggcatcgtgtttttactcgcctttttgctgctgtttttatttgcgacgctgacatcggctttttcaatgcttgaaattttagttgctgttttgtcaaaaggcgattcggcaaaacggaagcggtatgcgtggatcgggggacttgctatatttattgtcggggtcccttcggcgctgtcgtacggaattttgagtgatgtttctatttttcaccgcagtatttttgacgctgcggattttctggtcagcaatgtcttaatgccgctgggcgcgcttttaattgccgttttcgtaccgctgaaaatcccgaaacagatgctgtttgacgaactgaaaagcggttccggtataaaacgaaaatggtttgcagtctggctcctattaatccgttatgtggctcctgtagccattattatcgtttttctgcacgtgcttggtattttttaaaccaaaagaagcaggcccccgttcaagacgggggcttttttaataaagcggccatatcacgcggtgcgcttgctcgaaccgtttctccgcctcccgccaatcaacgacattccaccattgatccacgtaagccgctcggtcgtttttatattgtaagtaataagcgtgttcccacacatccagcggaagcaaaggaatgacgtcccactggctgtagagctgatgcttctcagcggccaaaatctccagccgcccggcgcgcggcgcccagactaggatagcccagccgactccttcgacttttttcgccgcttgagaaaattgctctttaaaagcggagtagcttccgaatgacacatcaatcatttgaaagagtgcacccgtcggccgtctttttccgtttggattcatcgaaaaccagaaaatactgtgcaaataatggcccgcgccgtgaaacgccaattgccgcccccaatgtgccactaagtcgtactgtttcgtctgtctcgcttttttgagctccagttctgctttattcagaccgtcaacatagctctgatggtgtttggtatggtggagtttcataatctctcttgaaatatacggttccagtgcggaataactgtaaggcagtttagggaggacatgcttgccgatcggcacataagctctgcgctcatccggctcttcgggttcagtaatgtcccggtaaagtgctgatgcttgttcgtaccattccgcctccgttaatccatcatcctgaagggtgtgaaaaatccggtcgatttgtgccgcgaagcgatcgaaccgaccttgctgaataacttgttccttcaaggtttcacaccaattcagcatttcggtttgataagcgtgccgtttcatttttcttcctccttttcactcattttcataaaagtgctgagcgcaagcaaagaaaacacatacgggtagctgtgatacctgatgtaaaactgcttcggcaggccgattccggtcggatagctgaaagcggctccttcgtaatgccggttttcaataagaaaagatatgccttttgtgacggcttgatgatgagttttttcgtattgcagcaaagcttcggccgcccaagccgtctgtacaagcgtcccgtaagaaagcggaacataggttttctcttctgcgcttttacaggattccccccagcttccgtcctcgttttgaatggacttcagccagcggatcgcttttttcacggccgggtggttttggctcacgccgcaagccttcatccctgtcagcgctgcccatgtgccgtaaatatagcagacaccccatctgccgtaccacgatccgtcctcttcttgatggcggatcagccattggacggccttttcaatctgagggtgatcagaagaaagccccgcttctcctaaacagtgcagcacccgtccggttaagtcgcttgttgagggatcgatggcagcttcctcagccgattccagcggcagcaggcggaccagcggatgattgacatttttctcaaaagcagagaagccgccgtcactgttttgcatggacaaaagccagctcagtccgcgttcccatgaggcgggataaagttttcgcggaatggctttgagcactgcggctgtgtcatcacaatcaggattatttgtattgatgtttgaaaaaccccatcctcccggttcagcatgcggattgtgaacggcccaatcagcgactttcgtctgctgccgttcacgcagaaaccgggcggcgctggttatcatctgatcgttatctgagatcccgcttttcataagcgcatagttgagaagcgccgtatcccaaacggtcgacgttgaattttccaggtacggtatatcgccgcaagacgtgagcaaagctttcgtgccggcaagtgcttttctgataacgggggagtggcgcgatacaccgagagcgagcaggccgtacaccataaaaatagtggcgctcgcatagctgtataatgtgccgtcttcttcaatccggtcaagcatatacgttttggccgtacgcagaccgagctggtgaaaagcggcaggaatctgcaaaagccgcttccagtgcgcgaaaagagaagagaggtctctgttctcatcctgatcggaacgaagccatgtaaacggatttttagtcatatgccgatctaaatgcgcgagagacggaacgttgggatttttcagcgaaaatcttttgttaagcgtcacggccatcggtacaaaatgaatacgggcgtatgtactgaactggtaaaaatgcagcgggaaggatgggggaatgactaagaaagataatggcagatgcagcgcgggccatggataaaggccgtttgccgcaagcatccactttgtcatgaagtgtacgttgcgcaagccgccatttgagatgataaagcgttcggcctgaatcatatgcgcctcagaacggctatataaaccggaagccagcaagccggcatagccctgtacagtggcggtcacatttcctttccggtcatcaggatagttggcaaaagttccgtccgggcgctgtttagcgcgaatgccttctgcaagctcagcgatcagttctttatcattgtctccaagagaagtgaggaggaggatcagaaaggcgtttgtcaaaatcggtccttcaaaacaaaatgaccatgagccgtccgcattttgcgtttctcttaatagggagatggttttcttttggcggcttctgacgttttcatgaattgtgctcacactcgctcaactccttcagaagcatatatattcatatgtaaaaggcggcatgacaaaagaaagaaactgctgacaggcagcagtttcctgtttgattaatcttccagattgatccagacgcttttcacttctgtataattattcagcgcgtaagagcccatttcccgcccgaggccggattgcttatagccgccgaaaggagatgccgcatcgaaaacattgtagcagttgacccaaacggtgccggcttggagacggtcagcaatgtaatgggcgtttttcacattctcagtccaaagtccggctgcaaggccgtattccgagcggttcgcccgctcaatgacttcatctaccgtatcatacggaatggcggctaaaacagggccgaaaatttcttcttttgcgatggtcatgctgtcatccacatccgcaaatacagtcggggagacaaaatacccttcttcaaacgggcagctgccgcccgcgacagctttggctccttccgcttttcctttttcaatatatgaaagcacgcgctcatgctgttcctgactgacgagcgggccgatttgtgtatcttggtgaaggccggcgccttgctgaagcgatttcgcatatgaaaccatttcgctgacgacctcatcatatttgtctttgtgaatgaagacacgggagcctgcgcagcatacctgcccctgattaaacatgaccccgtttaaagcgccgggaatggctttcttcaaattggcgtcaggcaaaatgatgttaggtgactttccgccaagctccagtgtcacgcgtttaattttttttgcggctttttccatgatttttttgccgatttctgtagagccggtaaaagcgagtttatcgacatcgtcatggttggtcagcgcttccccggccgtctcgccgaaccctggaacaatattgatgacgccgtcagggaagcccgcctgatctattaattccgctaaatagagggcggtcagcggtgtctgctcggccggtttcaaaacgattgtgcagcctgtggcaagggcggcgcccattttccacatcgccataaggagcgggaagttccaagggatgatctgccccacgacgccgacaggctcatggcgggtgtaattaaaatatgagccggcgaccggaatcgtttgtccggttatctttgtagaccatccggcataataacgcatatgctcaattgcaagcgggatatccccattcgtcgtttcattaatcggttttccgttatcaagtgtttcaagctgcgcgagttccgttttgtgctcttccattaaatcggcaagcttatacatcagcctgcttctggaagcggccggcatagtgcgccattcgccgtgatcaaaggctttgcgtgccgctttcactgcactgtcaatgtcttctgtctgtgcctcgtaaagcgtcatcagcgtttctccggttgccggattcggtgtgacaaatgttgatcctgaagcgctaggaacaaattttccgtcaatataaagtttcttcgtgccctgtaaaaatgtttccagcctttttgtgatctgcatcgttaaagaactcattcgtaacaaacctcccgaaatttttttatggtctgttttgagcatcttgatgtccgcgcaaagtaagcgcatacagtcattctataataacagccccggtaaaatcaattgataaccgttattgcaattcacaagaaaaaacggctacaataagcttatcgattaagaaaaggagttttataaatgattcataataattggcagacaaaagaaagcgtcaaaaaggtcaaatgcgtacatacagatgcgaaaaaatacattgtcaaaaatgtgctgacgccgggtaaagagtatgaagtcaaaaatgaaacagaagaattcatttttgttgtagacaatacaaacaaagtcggaggcttctacaaagagtattttgaagaagtttaaagctgaatgaatttattttgcctgagccatactaaaaaagactacatataaagggtggctgcaaaatgaaaaaaacagagcaagacaaacaaaataaaacatcagatcagcttcagcaagtgcaacctgaagaaggcaccgacacgacgatggaacaaatttcagatacctataaagaaggaacaattgaagatacggatcgttgatgttttgttgaaaccgcggcattggagaagccgcggttttttatggcgaagataaaaaactgacttttcgaaaaaaataccgttttcttgaaaccttttctttcgctgaaccgtactacttcataaaagcggcacctttcgcgaagggcttttttgatgaacgttctaaaaatgtaatctgttcgtaatggtttaaatgccgtctatgtcgtattcttatatagggataaagaacttatttttttatgattgtaataaaacaatagtatagaagcagaaagtggggttcttcattgggaattttttctgtcagcagatcaaccgacacaaaaaagctggaggctttgctcgttgagggagaacggatcgaaacgatttataaactgcgggttgaccaaatatgctttacgaataaacgagtgattttctttgataataaaatgttctccaaaaagaaagtgcgcgtatttcttccatataaaacaattgaaagcttcgccattcaagaagcggggatgtttgatcccgataccgggcttgtattaatgacaaggggaaaaactttcgaattggaatttgcaaaagaaacggacttgactgaggttcaagccatcttaacaaaatacttatgcagttaaatatcacataaaagccatccgaatgcatgcggatggcctttttattatataatgcttgtttttccggagttcgaatcaatgagatccggatcagcaatagaactgatggggatataaatcggcgccaaatcaccattttcttcaccgaatccgtagttgatcttattggataaaaaataatcgatttgctgatacgggccgatcgtaatggaagaaccgcggtcgactgcatttactttaaagcctcctacatttaccaaaaccggcgaaaacatcataatgggcctccttttccggcagggattttatcgcatgcagactcaaaggtagatggagaatcaatttgatcccggtcatccactttgccgttcgtgccgatgaagccgcttgcatctccgaagttctgtccgtatccctgattctttttatcagaattctgccattccgccagtaaattttgtccgacattcaccgctgaagcattttcaaaggaattaattttcaacatgaaaatattaatattgatatatggagttggttgaaccacaggcaaacctcctttaatacaggtgtatgccggctgttatgaccgtatgcttagacagggggcgataaaaatggatttcgataagatgaagcaatggatggaaatggcgcaaaacatgtccggcggcgacttttggaaaaacgtttttgatgatgaacaactgaaatcatttcaaaacggccattctcattttccctttcaacagggagatgggcaaatgagaagaaatgaggatgcttttcctcttatagatattgtggaaacccatgatgagctccaatttttactgtatctgcccggctaccggaaacaagatgttcagctgctgtcctacggagaatatatcgtcgtaaaaggcacgagaaaatccttttttaatgaacaggattttaaacagaagaccggaaaatacggcgattttgaaaaaaaactcgaccttccgcattccgctcagggaacaaagggaatgcaggcggtattcaaagacgggattttatatatatcgattgctaaacatctgggggatgcaagccagatcattatcgaaggctgatcttgtttgctgtgccatctatcagatctgaatcatcgatactcatgatagggatgacgacaacggtgcaatcaccgttttgttcaccgtacccttcatttcttttattggctactgtgtttctcaccataacggaagagccggtgttaaaagctgctccgccgctgattccgttcatttttatatactcaaaattgataacggatggaaaaaacatcatgattcgcctcctttttgtatatcatgtttatatattcgcaatgcgggacgcatagaactttccaagagtgacggggaaagaagtgattttctttgaaaaaaataatgaaagagattttcaaaaaagtgtgtgaagaagaattagaccggcttaagaaagtggaacaacagcttgatgagcttcaggataagtgtcattttgagccgcagacggttgaaggggaaaaaacatatgtccatattgagcacgtcaaagtggacaaggttgaatacaatattgattttgaaaagctgagtatagaagagctgagcggtatgctgaatatcggcgccacttaccatacaccggcgcacaggctcaaacaagcctgcgctgaagaatttcgggacgacccgcaaaatgatgctgcgaaagaaaaaagacagacaaagcagcagacacccaatgtcaccatcagggggagaaaccattgaccccgttgtttcagcctcctttttcgagggtatgtattaacagatgcagcgaagaacacagacgaaaaaggagatgatgaatatgtcattatcaaaagtacagcaggacagcctttatcataaattaatcgatttaaaggaaagtcttcagggagaatcaaaagaaaatcattcaatgagcgaagacacaggagaactgtcgaacggagtagataatcacttagctgatcacggaagcatttatttggacagggtcacgaatcaaacgctggacggtgtcgatcagaatcttttagatgaggtgaacgccgcgcttgaacgaatggataaaggaacatacgggatttgcgagaaaacgggaaaagaaattccttatgaaagacttgaagccgtgccgtacgccagaatgaccgtcgaagcgcagcgagaaacagaaggggatgtgaaaacagacgctccgtcatatgaaagggaatttcacgagcaggtgaaagacctctcaaataaagaaaccgttgatcaaaaaagctcacaaacttacgaaatcctggatcgcgagcaggattcacaataatagcagcaggtacattcatatgtacctgtttttttattccataaaaaatctcaaaatcgaaataaaatcattgactttatataaaaaagaaagtaacatactatttgtaagtaaatattaaaagattaccgggaggaatttagaatgtctcaagtattatttgtaaaatcaagtgaccgtacggctgaagaaggcgtatccgtaaaattatacgaagcgtttctggctgcttataaagaaaacaatccgaatgatgaagtgatcgaacttgatcttcataaagaaaaccttccttacctcggaagagatatgattaacggaacattcaaagcttcaaaaggaattgaaatgacagacgaagagaaaaaacaagcgtcaactgctgacatttacttaaatcaatttgtcaaagctgacaaagtcgtgtttgcattcccgctttggaacttcacagtgcctgctgtgcttcatacttatgttgattacctgtctcgtgcaggagttactttcacatacacgcctgaaggccctaaaggtctgatgggagataaaaaagtagcgctcttaaacgcacgcggcggcgtatattctgaaggaccgatggcatctcttgaaatgtcattaaacttcatgaaaaccgtcctcggtttctggggtgtccaagatcttcacactgttgtcgttgaaggccataatgctgcaccggataatgctcaagcgatcattgaaaaaggactgcaagaagcgaaagatctggctgcaaaattctaatttccattaactcttgcgcccctacagggtgtgagagttttttctattatagaagaaactggcggcagctttcgatctgatcttatattgatatattgatattttgtcgaaaaaacaatttttatgtagaataaagcatttttcacaaagaaaaaaggttttctgtaaaagaattaaccctcttgccaaaatacgactgatggtgtaggatataagagaagctacattgttcgtattgttaattaagttttaacctttaagctgtaatagggagttttatatcgaagccggaatgtcatgcctccattgcagaggacgacaggaacgcttctgcaaacacccactttgaggagtggtggtttaaaactttcttacttgcgtacggcatacgtagcgaaagccatttcccttgcggagatggctttttattttgaattgcccttgagcagcgtactttatcagtatgataaaatgaaagaatcaaagacaaagtgaggttttacaacatatgctggagaaagcccaatcccttctggcgcattattttggctacgacagtcttcgcgcgggccaaaagcaggcgatacaatcagttgcagaggaaagaaaaaacacggtctgcattatgccgacggggggcggaaaatcaatctgctatcagattcccgcactgctgtttgaaggaaccacaatcgttatttcccctcttatttccttaatgaaagatcaagtcgacgcgcttgaagaagcgggtatcgcggcagcttatattaacagcacccagacaagccgtgacattcatgagcgcctgaccggtttgaaacaaggggcttaccggctcttttacatcacaccggagcgtttgacttcttctgaattcattcacatcctgcagaatattacggttcctcttgtcgccattgacgaagctcactgtatatcgcaatggggacatgatttcaggccgagttaccggaatatcgaaatcctttttaatgaattaaaagaaccgcccgtcatcatcgcattaacggcgacggctacgcctgaggttcatgatgacatctgtaagcagcttcatattaagaaagaacaaactgtatataccggttttgccagagagaatttaacgtttaaagtagtaaagggcgaaaacaaagaccggtttatcgagcggtatctggaaaaaaataaacacgaagccggcattatatatacagcgacaagaaaagaaaccgaccgtttatatgagaaattaaaacgcagcggcatcaatgccggccgttatcacggcggattggcggatgatgacagaaaagaccagcaggagcggtttcttaacgatcagatacaagtgatggtagctacgtccgctttcggaatgggaatcgataagagcaacatcaggttcgttttacacgcgcagattccgaaagatatggagagctattaccaggaagccggacgggccgggcgcgacggtcttaacagcgagtgtgtgctcttattttcgccgcaggatattatggtgcagcgttttttaatagaccaatcggccgccggagaagaaaaacaaaagcaggatctcaaaaaactgagacagatggtggattactgccatacggaagattgcctgcagcggtttattctgaagtatttcggcgagaatgaggcggaagcttgcggagcatgcggcaattgcactgatacaaggaccgcccatgacgtcacaaaagaagcgcagatggtattgtcatgcatcatcagaatgaatgagcgcttcggaaaaacgatggtggcgcaggtgcttagcgggtctaaaaataaaaaagtgctggaaaacggcttcagcagcctgtccacttacggcattatgaagcatcaatccgcagcggaaatcagtgattttatcgaattccttatttcagatgaatatatcagaatggcggacggcacatttccgacgcttatggtcacccaaaaaggcagggacgttctgcttggaaaaagcgcagtctcgagaaaagaagccttacaggccgccgccgttaccgagaatgatgaattatttgagcttctccggcgtctccgcaaagagattgcagctgaacagggtgtgcctccatttgtcgtattctcagatcagacgttaaaagaaatgtcggcgaaacttccgaaaacggatcaggatcttctttccgtaaaaggggtcggggaacaaaaaagattgaaatacggagcagtttttttagaagaaatccgaaattatgtaagagaaacagagtgaaaaaaagtttttttagaaatttgcacattgtgtttttcattcgcgccggaaaaatcagaagcttgaaaacccttgctgtatcagggtttcagcaagacttaccaagcgagagaaatgtttcatgtaaaggaactgtaatctaattcaaatcgttttgttattgaactgacattttcatatgttacgatatcacctgttagccgccaataaaaagctaacaagggaggatttacttatgaagaagacgattatgtcctttgtcgcagttgcagcaatttcaacaactgcatttggagctcacgcttctgctaaagaaatcacggtgcaaaagggtgacacgctctgggggatctcgcaaaaaaacggagtgaacctaaaggacttaaaagaatggaatcagttatcttctgatttaatcattgaaggagagaaactgactatttcttcagtagaaacaaccacatctgggcagtacacagtgaagcagggcgacagcctctggaaaattgctcagaaattcggaacatcagtcggcaatctgaaaagcttgaataacttgcaatcagatataatttacgcaggcacaacgttaaatgtgaaaggtcaggctcaggctgcacagccggctcaagaagccagccagccgcaaactgaacaaaaaccagctgccgagacagaacagccgaaacaagaagctgtcaaaaacgagcagcctaaacaagaacctgttcaagaacaacaacctaaacaagaacctgttcaagaacaacaacctaaacaagaagcgaaggctgtcgaagcaaaacagcagcctgttcaatcaaatacaaaccaacaagagcctaaaaagcagctgacaatgactgcaactgcttactctgctaacgacggcggcatttccggtgtaacggcaaccggtgttgacttaaacaaaaaccctgatgcaaaagtcatcgcggtagaccctagtgtcattccgcttggctctaaggtttatgttgaaggttacggagtggcaacagcagcagatacaggcggcgcaattaaaggaaataaaattgacgtatttgttgcaaagaaaagtgacgctaacaactggggcgtcagaacagtaaatgttaaagtattagactagtttcatatagagatgaagaacacaaggcgaaatgctttgtgttctttttttcttcccttttttgactgtatataatcgttatatgcggaaaaagaaaaagcgtttctctaatataataaggaatggatgtgaaaacggaatctgaagggatgtatgaatctaatggagccggaatttatatgtttatggaatgccttcacagaatcaccggtgtttcatgcaggtatatgcaccgctttcgccattgtgctcgttatcggactgtctatgcctgctgtcaggctgtttcaggcgcttgacagagggagaggaaggccagccgttattgaaaaggtgagacgtactggcgtgatgaagaatggcaggcacgagcttgtgcttattttaaacgtaaaaaaccaagacggaacgcatgataaacgtgaactgacacatgccgtatataatgaagagatcagccgtttttatgaaggagcttccgtatgggtgacggcagcggctggcggacgaattatgatcgctccgcgcacgccgcggcataaggcgtcaaaataaaaagacggggcggttttcccggctttatgtattaatgccgatcgatccatatccgtccgccttctgagccggcttctatcctgcatgttcctccgatcgggaatgtcatcaaaggggaggtatggccgaaatcagcatttgcgataacaggcatggatgacagttcttcttttgtacggatgacggcacgcagagcctcctcagacacatttgaagcatgctggaaacgtccgatgacaattcccttcacggctgaaaaagcgggaaggtggatgagtgactgcaaatcccggtcaaacatatgaatgtccgacatataatcatcttctataaacagaatcacttgctccatctccggaaagtattcggtgccctgcagaagattcagcgtgcatagatttcctccgatcagtgttccttccgcatatccgggttgaataacgagcggtcccggattccgataaaaacgtctgtcctcctggttcaaataccatttatcatcactccactcggatgaaggctttacctcatacgggttgtcagaagcacagcaggccaagaaagagtcaatcgtatagtccagcccttttttcatggcaaatgaagaaaaatggggaccggaatatgtaataaggccggttttttgatatatggcatggccgagagcggtaatatctgaatagccgcaaaggattttcggatgccgcttgatgttttcataatcaagatagcggagcagctgatttgattggaacccgccgagtgtcgtcaaaatcgctttgatgtcagggtcagcgaaagcctcgtgcagatcccgtatacgcgattcaatggatgatgaatcaaattcatttatttctttcgcattctctgaaaaagagacacaaaagcccagctcctccaattttgtcttcgcggcatttatattttcatctgacataacggacatgcttgtggccggagacacaatacgaatgccgtcaccttttttcaatttttccggatacaaaaaaaccctccttaaatggtttaatctattacaccatattaacgagggtttatctatcattttttacaggtcgacccatttaatgccgcctgattgcgtatcattgtcaatccagacatcaaagtgatgcttttcataaaaatgaacgagtctgtcgacatgatcccaatcacgcttagcgatgtcgcctgtcactttcgggatattctgctctctggcgatatgttttaaaaatttcatgcagatcgagccgtagccatggttcggcgggcctttaatgtccccgatatgaatggcattgtcataataagaggcgatcagtgaaaaacagcctcttcccctgtaggctgattcacaatcagtcagcataatcttacatgtttggccatcatcaatcgaggaaacaatgatccaatcgtcattgttcgattgatcaataccaagcactcgcgcgtcttttgatacatctatcagattttcccgcattctgaaaatctgaaattcaagtttatgaagctctttttccagctctttctgatctctttcttctgcagtaaacaaaatcatactcctttcacagcgtaaaagtcttagttaaacacaagtatccattgtagtaaatgatgtcttggtttgtaaatgggttttgcaaaaacttttttagaaaagtctgccgtttatatgtggattgacgtttttaaggcggtgcggatagggaaaggaacagtgagcagcggaaaaaggaggaatctataatggcaattgactcactcatcggcaaattgaagtacgtaatgacggaatctcctgataaaatgctttccttatatgtaaatacggatatgagaaatccggatcagcaggggggagagtggaaaatcgccttgaaaaccggttttcggagattaaaagagtatctgtctgccagtgatccggaagaagaaaaatctctcgtccgcatcatggaacgtgtctatcaatatatcgatgagcttggtaaagagatgccgcgaagtctcgtattttttgcgtcgggagaaggcggtatttgggagacgattgaattgcaggtgcctgttgaaacacgattttattgggaagagacggctgtccttgatcaattagaacttcttcgtgaacaatttccgagcacggcttttattctcacccagcagaatgaagtgaagatcatagaaaccgtactcggaaaaattgaaggagtggagcattatcattacgacgtcatcaatgaatcgtggaaaccgcaggatgtaagcggaagcctctccgcgtcgatggacgaagacgctgccaaagcccacgtcgaagaaaaccaaaacaggctgtataaacgattggcttcaaaccttgatcaaaaggccgcttcacaccaatgggagcgtctcgtaatcgcaggggacaaagaaacagccgatattctcgatcagcacatgaataaaccgattgatcggatcattccaaaaaatctgttgaatgaaaacgaacataaggtgatagaagaactgttgaaggaagcatgatatgacgaaaggccgggtctcaaacacccggtctttttagggcttaagtttgtctaatttctgacgaagcgggcgaaaccgttgacatcaaagctgaattctcataccatttggatagtcagtaaaattgagagaggtcataagatgaatcagacagaaaacaaacctaaaagttataccggtatcgtgctgacattgaccgttctgatcaacgggttaattgcggtgctgttttttatgccgaaatcgggacaggtcagcattgccaatattcatattctgccgatgttaaatgccatttttaacagctttacttttatctttttgctggcagcgctctttatgattaagcaaaaaaatattcaagcgcataaacgctttattttggcggcgtttacgacgactctgctgtttttgatctgctatgtcgtataccactctgtggctgaaaatactttattcggcggccacggcatcattcgggggatttatttctttattttaattacgcacatctgtctttccgccgttatcgtgccgcttgcgctgtttacgctgatcagaggattcagcatgcaagtggagcgccacaaaaaaatcgcgagatggacgatgccgctctggctgtatgtcagtctgacgggtgtcattgtatacttaatgatctcaccgtattattaaaaaaagccgtgctctgcgcggcttttttctattgattgaaaaaggcgcctcatcagggcgccttttactcttcaagcgtttcaagtgttgttacatttaaggattgttcaacggtttttgtttttgcttttactttttctgcgtacgtgtaatcaccatagcagtagggataacggaaattgtctttgttccctccgcaagtgtaaagtttcggattctttttgacctgctgctcggagtattgttttgccagttcctcagtatgcgatcctccatgttcagccacaaaatcaatatagccggctcccatgttgtagctttgtataatcgtatccaagtctacgccttttttcttgcctgtttggtacatgagagtgaattgtttgattccctgtttgatactggtttgagggtttttaatctcatttcgctttaaacccagagattctgaagactgcatgggatcatttcctcttccttttgactcctgatatatcatgccgagtacaagcgatgtatatttggtgagtcctttttcatccagctcgtcttcaacaagcggtttgtaatctgtcagccgttcaaggacgatcggcttgacatcaaacggaagacttttgagccattcattatttgaaaataacagaatgaggaagaaggaaaccatgacaaaaacacatatcatcataagacccgcggcagcgaaacagccttttttctttttctccactgtgtttcaccctcaatttcaggagcattatgactttttcattatgacacagatgaatgcgcgaaaccaagcggaaacccgtatttgaaacataaatttaaaataacggttcttttgtcaggcgcaggatgtatctgcatcaattgacatttggtataattgggctacttgagaaaagaagggtgaggtatatgactgaatttcacgaatccggaaacaaaaatgaccccgctgtcgatttagatgaggaaactttatttttggttgcccagacttttaaggcgctgtctgatccgaccagaatcagaattctccatttgctgtcacagggtgagcacgcggtaaatgatatcgcagaaaagctgaatttgctgcagtctaccgtttctcatcagctgcgttttcttaaaaatctgcgcctcgtcaaatcacgcagagaaggaacatccatctattattctcctgaggatgaacatgtgttagatgtgcttcagcaaatgattcaccatacgcggcacgattaaaaaacatccctgcttttgagacagggatgtcagccgtactgactgttattggtttggtctctgctcgtttttaaaacataaaaagagaagccgctgtaataaactgcgatgaaataaaagatactgatggtcagcggatcggccccgaccgtttggctgtatgcctccggatgggtaaagtccgctgtgacccggtaaatttcaataacgcgataaacaaatctcgataggaataacgttaatagaataagttcaatccacaggtgagtgcgaaaatatatttttccgcggcgttcttcaaaagaaatgttccgtttagcaaacaggaccagaagccagccgcaaaaagtgccgaatataagatggccgtataaagccgggtgtgtgatgctgaaaaacgccagagctgcggccagcaatgaaaacaaaatcattcttgtataaagccagcggggtttcaaaggctgaaagccgacggaccgtttcacctttttatacagaaaaaaggcaatcattaagacagggcagatgctttgaagtgtgatatgcatggtgtggaactccccctccgttgagtagtgtatgcttatccggctggttttagtagtgtgatttattcgcaggctgaaagcatcttttatcacattatgcacgtttctttttttggcataagagaatcgcccgcgcctttttcaggatttaaacataaaactcttgaaaaactaacggtattaggtataataaaactaatgatattagttttaggaggatgttcatgagaatcttacaatacggaaccgtttggcagctgactttttttccagcgcttttcccggtgaattgttatttggttgaagaagaagaaggagtaaccctgattgacgccggactgcctaacagtcataaaggaatcaaacaagcattgcggcagcttgggaagccgctgaatgacatattactcacccacgcgcacggggatcacatcggttcgcttgactcattagctgcggaatttccggatgcttccgtctgtatttctgagcgggattctttcttgctgaaaggtgacacttcattatttgagcatgaagcacaaacaccgataaaggggggagtgccgaaaaatgttcagaccgaacctgatcgcctgctgaaaggcggcgagcggatcggatctttacttgtcattcccgctcccggtcatacgccgggaagcctcgcttttaaagatatgagaaatgatatgctgatcgtcggagatgcctttcaagtacggggcggccttgctgtttctgggaagctgaaatggaaatttccgtttccggcttttgctacgtggaataaagaagaagctgtaaaaacagcaagaacacttatcgctcatcaaccaagcagtctggccgccggacatggaaatgttctctgcaatcccgttgaaatgatggctgaggctgctgaggaagccgaacgaagcctgccgggaggccgatcataatgtcaccgagagtcggaatgagccttgacatgatattgagagccgcagcaggcatcgctgacgaaaaagggctgaacgaagtgacgcttgcggctgttgcaaagtccttaaacgtaaaaccgccttccctttacaattttgtcaatggccttcaaggaattaaaacagagctggctgtctccggtttaactatgttatatgaaaaaatggcggcctctgcagaaggactgacgggcgaaacggctttgcttgctcttgccgatgcctatatcaatttcgccgaagccaatcccggattatatgacgcaacatttcaaaagataaaagacgggcggattgagaatctgtcaagcctgcttgtagagcttgttgtcaggcagctgactgctaacggttatgcacagtctgacactgcgattcatgctgcgagaggactgaggagccttcttcacggatttgccgtgttgagaaaacagagtgcatttgaattaaccgaatcaattaaggaaagccggaagtttgcagttgttgcttttctaagaggtttgcaggagagggaacaataatattattatgtaaactaaataaaaagacgcatcatgtaaaaaggagggacaaatggattcattacaacatatcatttgtgagcggcgcacctattcacatatatttgattctcatgcacacacatactgccaaatgctctttccgctcgaaggacagctggacctggagacagaaagacgtaaaatcagattaaaacctgatcaaatgctgtatattccgcccgggcatgaacatcggttccgttctttggagcgaaatgaatgtctcgttctcgacataccggcatattttttcaaaggttcattagaccccggcgttctgaataagcttgatcctttttggacatcgattcggtttctgctgacagaagagacaaagcagcagtcggctcattcattgagtctgcttgcagaatatattgctgaaaagatacaagtaaaccgtacgaatgattcaattgcgtatatccgccgaaatctatcaaagacttttacaattaaagagcttgccgcaatggaacattaccacccggcgtattattccgactggtttaaaaagcagacggggaaaagcccgcaagcttatattgctgagctccgtatgaagaaagcggaacaaatgcttattgaaacaaaatgccggctgacagacatcagtcaggaggtcggctttcaaaatttgtcttcctttaccagatggtttgtcagacataagggaataacgccgcgcgtcttccgaaacacctttcaatctgataaataatcctgaaaatcggttaaataaactgcttctttttttggtatcatgattgtaaaaaaggagtttttgatatggcagtcatcgaagattttatcaagcttgatcttagaataggaacggtcgtaaaagcggaagtattcccggaagcaaaggtgccggccattaagatgacaatagatttcggcgaaaagatcggcatgaaacaatcaagcgcccagattacaaaacggtacgaaccgggtgatctgatgggcagacaggttacagctattgtcaactttccgccgcggcggatcgccggatttaagtcagaagttctcgttctcggcggcatcccggaaaaaggagacgttgtcctgcttacgccagagcagacagtaccgaacggaacgaaaatcggataataaaaaaagacgtttgcagaagcaaacgtcttttgcgtattgaggcgatacaccacacgccacattcgtgtgtgccgcaagggcatgtgcatcggcttacacaattcagctcatcgctatatcaatatagcatgccgggtgtggaaatgcaagagattttttaatatatgttatatctggctttgttttaccgatcccagattccttcgtgtaaggtttaatttgaaattttatgatcttgaataaagcagttcgacaaatgcaagagattcatctaatcttatatcctatggtaaaatttagacagaaagaagcagaaaggagccgtaaatgaaagtatttgaagcagcctcgttcatttcagccgcagaaaagcgggcaaaacaatacgatcagattagagaacaatttatcaatctcagaaaagcatttcagggaatggctgatttagatgacagtgagttttcaggcaaaggcgccgacaacattaaagcattctttcaagatcacgccggtgtcacagacagctggcttgatctgatcgatatgaagattgcgtttcttaacagtatttctggaaaagtatctgatgccggattggccgattcgtttgtggaagagtcatttttagaacacgagctgattcatgcgaagaataaatcacaagccatcatgcaggagcagcgcaatgaactcaaggacatcataaatgaaatcagcgatatcattcatcttgatgttttctctacagaagatgtcgatcaaaatctggaatcagcagacaaaaaacgggacgataccgtaaataggctcggcaagcttgatcacgatctaacaaaagaatacgccgaaacagaagcgaacgaacagttcatccaggccgactttcagcagctccaaaatgccacgggcaaaggaaaaaacgccactccgcttcactataacgccaaggcgtacagggaaagtgacatacataagaaaaaaggcgagattgcaagacattcagacacatatttaacgtttaagaaggaagaagcaaaagagcgggaaatcaaggatctgaagaaaaagctcgctgacggtgtgaccgatccggatgaatacttggaaattgcgaagaagatcggctatgaaaaccttgaaccttcccagcagcaatatgtcattcagcttgaacaagcaaaacagcttgaagaagccggagaagtgacttgggatattttaaaaggagccggcgttggtttatatgatgtcgggaaagacacggttagcgggttatgggacttcataaccgatccgggagaaaccttgtcagcactggggaatgcagtacttcatccagtaaaaacatatgatgctgtttcagcagcaatcgaggaatcgtatcaaaaagatatggtgaacggagatgcttactccagatcaagatgggtgacatatgcaattggttcagcagctgtggctgtcgtcggaacgaaaggcgcaggagccgttaacaaagctgatgcggcggggaaagtcataaacagggcaggacaggcagggaagaaaattaaagacgttaaacttccagaactgcttccttataactctaaatatgatcttgctctgtcgggtgacgtaccatacaatgtggttgacagccaaaaccttaaaaatgaacttttgaccaatgcaaagaaaatcccggatggaacgagaaagccgtttactggtcaagaaataaaccttccttggttaaataaagaaaagtatggtgcctttgaggttaagggcaaggtaaaagcaaagggaaaagttaaagacataagccgcagagtgtatactatgaaagatattgatatgaaccaaaaaaatcgtaaaggccttacgaatcttcaattaatgaaaagtggaaatgcaccttttgcgaaagatgggacacaaataaatctacaccatttaattcaagaggaacctggtccaatgcttgaaattccaaatagcttacatactaaatatagcggcattatccataggcttaaatctgatggtgaaagctttagaaacgatccggttttaaaagcccagtatgataatttccgagacaggtattggaaatggagagcaaaacaatatgaaaaataaaaaaggaatgagagatatcaatggacttatatgaaaaaactatagagtttataactgaaaataaagcagacagttattttactagaggaataagtgaaaaagagattattaatatagagaaggagctccaactacaacttcctgatagttataaatggtttctgagaaactttggctctggcggcttatatggaattgatattttagggtatgactttggcggggcttcggtagttgaaaccacagaggaatatcgtaattattatcatttatctgatggacttgtgatattagaagatattgatttttttgcttatgccttagatactaataaaatgaacagtaataatgaatgccctgtttttatttgggatagagtacttggataccaagacaagctagccgacagctttattgaatttttctacagaaggttgcttgaaaaaaaagaaaactgggaagaagatgaagactgggacgattaataaaagaaagctctctattagagagcctttttcagattttcaatttttaacaggctttataatgagcaaacaggcattactcaaaatactcgccgcgcctatccaaagcagccattgtgttgcggtcagccatgaggcagttaggataaagagtccaatggcaattgatatataattgccggctcggtccagtttatgtttgcaatgaattttatatttggcatgagaaataaattgatcaattttatctttcagctcatagcatttttccttcatcttatcctctgtttcttttacttttcgataaagcatattattcatcgtctgcactcccatatcgccgttttgaaaattcagccatgattttttcttcatagtcatctgagatgaattgtgcctgatcttcaactttcaaatgtgctttttcttcaaaaccatcctgttcttcaccatcaaaacgataaagtttttgcaatagcctccagaatgtttcaatttcatcagttgtgaagtcatgaaacatatccgctaaaaaataggtggatttttctgaacaggaaattaacgctttttttccttcagcggtaatctcaatattgattgcacgtttatccagtttgcttggcacagtgtgaacatatccttttttcgcgaggcttgaaattaatttgttagcggtttgttttgttgtgcccagctttttagcgatattcataagtgtggtatcttccgtcggtaaatgggcaatagcaataagagtcatgtgctgtcgggaagtcaacatttctaagtattcgtccccccgagcctgcactttattgacaaccgaaaataatgatgcgtaactttgttgcataacatgcagttccttcattagtaatttaatatccataagttatctcccatctaagatgtcaccatgttgacagttacaatatacatcacaaaaggaaattagtcaacatggcgactaatagtggcaggtgcggctgttttcaaaaatgtcacaggcagtcggagtgtttacaaaaggggaaataagtataataaatgcgaaaagggcattaatccaaagtgagaaggtgtttgacatgcagaaagtgaactggtcagaacagtatgaatggttcaataaacaagatgaaaaagacgggcgtttaatggcgctccttcgtcatgagcttacatatgaggaagtcatacggttatatatgaaagggttttatttgaaatcaaaagaaggggatgtttcgttaagtaagaacgatatccatcgtatgtttggggttgaagagagaaagggcggcacatcttgatgaacgggaagagaaaaacccttcccgcttttcatggaagctgttattctttttccagcatggaagtcagccattctcttaacgcagttttctgtacataccgctttccgtttctcgtgatatgcggaatgtcggaggtgtcgggcacgatttgtttcgcttcttccttggtaactcctaaataataaccgatatagaagtgcagatctttttctttaatgagaatgtggtcagtgtgttcatgaggatcaggtgatttaaaatttttcaatccgtctccgatgaaatatccggctaaagcgattccgatgccggtaatgatatccatacagcaaacctccaataaacgttatcactttttatacggtgaagccggccgaaaggattcagccttcatcaaaaccgctcggcgtttattgcggacggttttaattgctgagcttttccacctgcacctttccggagaagaaaacagcgcctcctcccatatccgccagccgatcgggcgtgagcgaattgacgagctgttttttatcatccatatcggcccaaagaccttggctgactgcaacgccgggaagcacctgttcgccgaccgaagctgttaattcacactcgccgcggtgattccaaactctaacggtttccccgtcttctatgttccggcgtacagcatcctctgtatgaataaaaagctttggcgctttttctaattttacgtgtttttcattattcgaaaatgttgaatttaaaaaattatgattcggtcccgggacaaataaaagcggaaaatcaccatcgctctcaagagggatatgtgtcggcagcgcgggataaccgtcttgtttcatcttttccgaatataattcaatttttccgctcggtgtcttgagctgtcccggaaaaagcggttttttccgtttggctttcatgaaggaatggcgtgagagcgcttcgtaatcaatatcctcgatatacggattgtcgggaaagtccagcgcctgtctgatcaattcttcatcggtatcctgaagctcctgctcggtaaatcccattgctccggcaagcaaacggaacacttccgtattcgatttgctgtccccgcagggttcgatcaccggtttttgcagctgaataaaatgatgccagtaagacgtgtaaaaatccgtgttttccaaagcggatgcagcagggagcacgatatccgcgtatttggcggtttccgttaaaaacagatcgtgaacgactgtaaataaatcctcccgcagcaggccttttctgactttattcgcttccggcgcaaccactgcgggattcgtaccgtaaataaacagggagcgcacgggcggttttgtttctaaaagaacgcttccgagcctgttcatattaaatgatcgtggcttcctgccgtaaagcagatcaggccgctggagcgcttgtctgttatagtttaataccgcgctgttgtgcttgattgcgcctcctccggtgttgagccactgtcctgtaacagccggaaggcaggcaacggtgcggacgatcattccgccattgtcatggtgctgaatgccgtttccgatcctgataagggaaggggaggtttccccgtacattctcgcaaggcgtctgatatcgtcggctttaacgcctgtaatagcagaaaccgtttccggatcatagtgtttaacatgcgcttttaattcgtcactgccttcggtgtattctgtgagaaatgcttcatcgtgaaggttttcgtcgaataagacatgcatgataccgagggcgagtgcggcatctgtgccggggcgaatgggaataaaccaatcggcaagccggccggtttggttcttatgtacatcgataacgacaattttagccccttttttccgggctttttgagcaatcatgacttggtgcatattcgtgctgacggcattgatcccccaaaaaataaagagctttgcatgtatggtctcctccggatcagtacccgctccttctcccattgtatagttatagccttcagaaccggctttgctgcagatcgtccgttcgagatgactcgctccgagacgatggaaaaaacggcggtccattccctctgccgccagttttcccatattgccgtaaaagctgtacggaagaatgctttccgctccttcttcggcaataagctctttccagcgcgcactgatcgtattgatcgcttcctcccaggaaataggcgcaaacgcggcttcaccttttttaccgatccgttttaacggaacggttacgcgcttttcatcataaatgcgctcagccatgtgtctgactttgttgcaaatattccctgatgtgaccgggtgatcggggtctccctgaatgttaacgatttttccgtctttttttgtcacaagcaagccgcattgatcgggacagtctagtgagcataccgacttaaagaccccgttcggctgtgttgcagcagaattcatagcccatttctcctctttgtttatattgtaagcattataacatttcaaaatcgaacgtcaattcagaaaaaaagtgttgacatcacggaaagacttttctatgatgagtttattcttttaaacagcctgacaatttcatcattttattttctatccagagaggtggagggactggccctacgaaacctcggcaacatttattgtgccaattccagcaagcgtatgcttgaaagataggaaagaatgatctatacatatttgtgcgcttcaagcgcataaagacggtatatgaatctctttccttctttggggaaagagatttttttatgacaaaatttatgtgaaaaggatgttttgcaccatgacggttttaattaccgcaccatatcacgacgaggggctgaaggagctgactgagctgttcggccggactgtgcaccggccgtggaagaagcacggccgggcctatcgggaagatgaattgatccgaatgattcaagagacaaacgcgtcggggcttatcactgaacttgatgaggtgtctgagcgtgttattgacatattgcctgattccgcttttatcggtgtctgcagaggaatgccgtctaacgtgaatattgcggcggcgactaaaagaaaaatccccgttttctttacaccggcccgcaatgcccaggccgttgctgaaatgtttatcggaaatgtgatttcatttttgcgtcatacgtattcttcccatcagtggctgaaggacgggaagtggaatggtgattatttgcaggcttatgtcaaattcagaggaaatgagctgacggggaaaacagtcggccttatcggtttcggagctgtcggacagagaatcgcccggttattggccgcttttgactgcaaggtgctttactatgacccatttgtccgtcatgaaaaccgggagtatgaaaaaacgacgattgaacgggtattttctgaaagtgatattgtttccgttcacttgccgcgcacagaagaaaccatcggccttatcggcgcccggcactttcaattgatgaaacaggaagctgtttttgtcaatacgtcaagagcggcggttacagacagggaagagctgctgcgggtgctgaaagaacggcggattaagggagcgatccttgacgtgttttatcacgaaccgccagaatcttctgattatgaattgatctctttgcctaatgtattagcgactccccatttagcgggcgcaacatttgaagtggaagatcatcatgtgaagattttaaatgaagcgcttttcaaatggaaacaagatcaaacctgctcaatacgtgaactttataacaaaagagaacttgaaacggaaggaggaggctgtaatggctgaacaaaaaggctaccttgtatttgacatcgggacggggaatgcgcgagtcgcggtcgtgactgccggcggcgaagtgaccgcgcttgaaagggaagacattgaatatgtgacggatccgctttatccggacggacgatatttctcaccggaaagattatggacgcaaatcagcgctatggcaaggaaggttattgccaaaagcccacatattacattaatcggaatcacctccacaagccagaggcagggaattgttctgatcaataaaggtaaaaaggcatttctcggtctgcccaacattgataacagaggccgtgaatgggaagacgggattgagacaaaagaagaagtgcatcagcaaaccggacgtcttccgagcgctttattttccgccatgaaacttgtcggattaaaagctagacagccgtctttatggaaagaagtgaagtacatcacaagcatcagtgactgggtgacatttgagctgagcggtattttaagctatgaaccgtcacaggctgctgaaacactgctgtttgacgtaaggaaaaaggcatggtcagagaaattatgcaacatcttcggtgtgccttctgccattcttccttcactcgtccgatctgggacggttgtcggaatgttaacgtttaagaaagcggcggttctcggtctatctgaaagagtgcctgtgattgcaggcgggggagacacacagcttgccatcaaaagtgcagatgcaaagccgggagatatcgtcatcgtatccggcacgacgacgccgattacaaagataacagcggagaccggaaccgaaagtttaacgaatgcatggctgaattgccatacagaagaaggtcaatggcttcttgaaacgaatccgggtgtaacaggactcaattatcaaaaattaaaatccattttttatccgaatgaatcctacggcgttatggaacgggaaatcgcaagtctgccgaaacatgatcatgcttgtatttctgcgttaggctcctatttatcgcctgagaaaaacgcactggcaaaaggcggatttatttttgacgctccgctgtcccaaaacttaagcagagcccattttgtcaaagccgcactgctggaaatcgctttttcaatcaaatggaactatgaggcgttaatagaggtggcttccttttcacaagatgatgtgaaggtgtgcggcggcggtttccaaagtgatgctttgacgcagtttcttgctaaccttctccaaaagaaaatctataagagagaggggttcagccaggcatccgcaatgggagcggcgatgatttgcaacgaagctctcggtgtgaaagcagagctttcgagccgcacaaaggtaattgagccggaagcggatcagacggatctcttcctatatgaagaatggaaacatacgcaaaaattatttactcattttcagccggcggtgaaagcctgacttggggatgagatgacaacatgaaagattgctgaggaggaacaaaaatgcttaataaaataggaattccaaaacagctcgcatggggatttttgggagtcgtgctgtttatgatgggggacggccttgaacaaggctggctcagcccgtttttagttgaaaacggcttgacggtacagcaatcagcatccctgtttacagtttacggtatttctctcgctgtggcgtcttggttttcaggggtctgcctcgaagccttcggcgcaaagcggacgatgtttatggggctgttgttttacgttatcggaacagccgcatttatcgcatacggatttgaaaatcttaatttgccggtgatgtatgtcacgtattttattaaagggctgggttatccgctgtttgcctattcttttttgacatgggtgatttaccggtcgccgaaaaacaggctcagtacggcggtcggctggttctggattgcatattgctgcgggatgtttgtattcggtgcttggtattcaagctgggccatcaaatccttcggctatttgaatacactgtggagttcaattttctgggtctgcctcggcgcgttttttgctttgattttaaatagggaccgctttgaaaagaaaaaggcagataagcgggaaaaggcgcaggaattaatgaagggaatcaccatccttgctgaaaatccgcgcgtgctctctggggggatcattcggatcattaacagcatcggtacatacggatttccggtatttcttccgatgcatatggcgcagcacggcatttctacaaatgtatggcttcaaatttggggaacgatctttctcggaaatatcgtctttaacttgatcttcggcgcagtcggcgatgccttcggctggaaaaagactgtcatgtggttcgggggagtgggctgcggcatttttactcttttattatattatgctcctgttgtatcacatgggaacttgcttttcgtcagcattgtcggttttatatggggagggctcctcgccgggttcgttccgatcggggctatcgtgccgacggcggccggcagcgataaaggtgctgccatgtctgtgttaaatctggctgcgggcctgtcggcatttgtcggccccgcgcttgcctgggcgttcatcggacttgtcggcgcacaaggcgttgtatggattttcgcagcgctctatttcgtaagtgcaatcttgacaaatcaaatcaaaatacctgaagagaaaacggcaaaacacaataaagcattgcctgaatacgcttcttaacagcagcgccccgaaaattcggggcgtttttttacagctgctgaagaaacccggcaaagcgctgaatttgttcacgtaacgattgtttgttttcgtgaaattgtttgaaacgatgtccgtttgctccggacggatgcgggaagccttccagaatgaccgcatgacccattctgccgttcttcttcagcatgcggcaggctgattctgctgctttgccgagagggataagcagaatgtcctttttcatcatttctatttcatccggaaaacatgtcagcgcgtaacggctgagaagagctgacctgctgattgccggccgatgtcccgtatagtttttctgtttataaaaaacagggtgtttgataacggacgttgtatgaagcagctcccgttttgaatcaaataaccgggatgaatcctcaacgtgaagcgcggccggcagaccgcattcattaagcatttcgatgatgttctgcctcattgaaccggaaagtccggccgctttttttgtttcataggctatcgtttcaaaagtttcgccatcttttaaaagctgtgccgcttttttgtaagccagctgcatttgaaaaaaaccgggtgtgattccggaaatggcaacgactgcataagggttaatatattcattatgaggcgaataatacaaatccagatctccgtccttagctaaatggaaagccggagtcagcaaatccgattttgtaaaccctcccgaagaagatagtgctttaagctgctgcaaaaaatgcgcaagccgctcacgatcgcaaatcatgttatgcctccttggatccgcgccagtttctcttagtgtcatcaaaaacgtcggatgacatgcaggctcataaaccgcttttaccggcgttccagagcattttcagcacgtgaggcgttcctttaacttcggctgccgtcgtttgcacggctgtttttttagtaagaaagtcttcctgcagttctttctgcttttgtgataacaaacgggtttctgttttgatttcatcaacggacgtctgcatggacgctgtcacggcgttaatcttctttatatcaggcgctgtgtttcttttaaaatggacggcggatacggctgcataaattaatgcggcagccgcaacggcagcactgatatacaaaatgatgatcatctgcttttcactcctttttttcagttgataccctttacggatcgtgttgaatcattttatttgctaattgttttttttctgcttataatgtgaaatcgtacataaggacattcagaaagggtgaaagacgtggaaagtttacaaaacaaaacggctcttatcacgggtgcgggcagaggaatcggccgcgccgccgctatcgctttagccaaagaaggagtcaatatcggtttaatcggccgcacagaagcaaatgtcgaaaaggttgcggaagaagtgaaagcccttggtgtaaaggcatcattcgctgctgccgatgtaaaaaaccaaaaagaggtagagcaagccgtctcctctattaaagaagaactcggtgagattgacatcttgattaacaatgctggaatcagcaaattcggcggatttttggatcttacgcctgaagagtgggaagacatcattcaagtgaatgtaatgggtgtataccacgtgacacgcgccgttctacctgaaatgattgagagaaaatcaggagatatcattaatatttcttctacggcgggccaaagaggcgccgcggcgacaagtgcgtacagcgcttctaaatttgccgttctcggtctgactgaatctctcatgcaggaagtcagaaaacacaatatccgtgtcagcgcaatgactccgagcacggttgccagcgacatgtctattgaattaaatctgacagacggcaatccggaaaaagtcatgcagcctgaggatcttgcagaatatatggttgctcaattgaaattacatccgcgcattttcatcaaaactgccggtttgtggtcaactaatccttaaacaaaaggggacctgtcttcgtgacgggtctttttttgtttccgcaacccgaataaatgggcataaagatccgtttttgcagaaaaaagagtgaaaaagaaaccgatatcagctataattaaactaaataaactatgtaccaaatgttcactaaaattatttttcctcgcctccaaaaaacaaatcaatacaaaccaaactgtccgaacaataaaagggaaaacgggatataaagagaatatttagtacatggaataatttgttagaaggaagggtgtgcacatattgaaagaagaaaaaagaagttcaaccggttttttagtgaaacaaagagcttttttaaagctttacatgattacaatgacagagcaggaacggctttacggactgaagcttctcgaggtgctgcgttcggaatttaaacccatcggttttaagccgaatcataccgaggtgtaccgttcacttcacgaactattggatgacgggattttaaagcaagtaaaagtgaaaaaagagggagccaaactccaggaagtcgttctctatcaatttaaagactatgaagctgcgaagctttacaaaaaacagctgaagacagagcttgaccgctgcaaaaagctgatagaaaaagccatttcagataatttttaaatccggccggaacgcccccggcctcccgggctcaaaaggtttgttctgtgattcattatacataatagcaggctcggaacaatacatatcaataataccttcaaacttgacatcaactcctgaagtggtaacataaaaaacgtgtgaaaaatacgaacaaaatacgaacaagggagatgttaccgatcttagatcaaaagaaagttgcttttatcggagcaggatcaatggctgaaggaatgatatcaggcatggtccgcgcaaaaaaaattcccaaccaaaacatctgcgtgacaaaccgccgcaatacagagcgactcgctgaattggaacatcaatacggtattcagggcattgcttttgacagcatgaaaaccgaagatattgatgtctttattttagccatgaagccgaaggatgctgaaatcgctctggctgcgctgaaacggcgtattcaacctcatcaaatcatcctgtctgttctggcaggcataacaacctcatttatacaacagtcattacatgataatcagccggttgtaagagtgatgccgaacacatccagcatgatcggcgaatcggcaacagctgcggctttcggagaccatgtctcttacggttcagcaaaaaccgcggtatcccttttggaatgcctcggggaagtgtacgtgatcaaggaagatcagatggacattttcaccggcatcgcaggcagcggaccggcgtacttttattatttaatggagtttattgaaaaagcaggtgaagaagccggcttagacaaacggctgtcccgcaaaatcggcgcgcaaacgttattgggcgccgctaaaatgctgatggaaacgggtgaaaaaccggatgtgcttcgggaaaacatcacctctccaaacggcacgacggaagccggcctcgatgcgctcaggtcagaaggcggcggagaagccattgccaaagccatcaaacacgcgaccgaacgttctattgagatcagcaaaacaattgaaaaaacggcagcactataatcgttaaaaaacaggagtgatacagtgacgtctcggacgaagatcaaaagagtcgcggtgaaaatcggcagcagctcactgacgagcctgcacggggaaatcagcagaagaaagctggaagcattggtggatcaaatcgcacagctgaaagacagcggctatgaagtgattttagtatcttccggcgcagtggcggcaggttatcggaagctcggatttattcagaaaccggaaagcctccctgaaaaacaggcttctgcttccatcgggcagggattattaatggaggcttattcaaagctgtttttagcgcacggttatgtcgcatcacaaattttaattacaagaagcgacttttccgatgaatgccgctaccataatgtgcgcaatacgatgaacgtccttttggaacggggcattattccgattattaatgaaaatgacacggtcacagtcaaccggctgaaattcggagataacgatacactcgcagcgaaggtggcaggtttaattgatgccgacatgcttgtgattttatcagacattgacggtttatatgatgataatccgcgcagcaacccgaaagcgaaaagaatcagtcatgtaagtgacatcactccggaaatagaagcaagcgcgggagatgccgggagtgaaatgggaaccggcggaatgcgttcgaaactggatgcttttaaaattgtgatggcctccggtattaaaggctttctcgggcaggctaacattccggacattctgcttcaagcggtagatgaggcggctgaaggaacttattttgaagcggaaggaaccctgccgttaaaccacaaagaacaatggcttgcatttaattccggccccgaaggcgaaattgtgatggaaaaagaaagcagccgcgatgtcgcgaacggaaatatggagctgtcaccgcaggacatcgagcagattaagggcagattcagcagcggagcggttgtcaggctgcttgatcagcagggagaagagctcggactcggcatcgtcaactattcctcagcccagctgaagacatttaaagaaacgccgcccaaacagaccgatcaatcagtcattgatccggaagcgtttgtctgccacgttgaactatccattccgatcggctgagaaagatctataaaaatatgaaaaagcccgaggcttcgttttgaagctcgggtttgttttttattgatattgttcaagtttggagaaaaattgaatgacaaaatgatagaaatcatttgcagacggagccagttcccttccttttggtttaataatgcctacggtgcgcttcacttgaggaaattcaatcggaattttgaccgtgaaccgaggggtggtttctccaaaggtgctttcaggtaataaagtaactcccatccccgcggagactaatcctttaatggcatctaaatcctcgccttccgtcgatacaagcggcgcaaagccggcctgtctgcaagcgtcaatcgccatgttacggagaataaacccttcaggaaataaaacaaattggtcgccgcgcagatcaattaaatgaatatttttctgtttggcaagcggatggtgcagcggaacaagcgcgtaaatcttttccgtgaataagatattgcctgttatgtcggggaattccgtcggaacggggccgagcagcgcagcatctatatccctgtttcttacggcttcaattaaaaacttataagacccctggcggagcaaaaactcaacgttcgggtattcctctttaaacgccgaaatcaccgtcggcaaaagctggcttgcaaggctcgtcggaaatcctattttgacggttccgcgattcggatcaagatattcatcaatttgttctttcgcgtaatcaattgctttcatcgccgttttaatatgttctaaaaattgtttgccgatcggcgttaatttaatatttctgccttcccgttcaaataaagtgacttgcagctcttcttcaagatttgcaatctgcctgctgatggcggattgtgcgacatgcagatgatcagccgcttctgacacatgttcccgttctgctacctccataaaataccgaagctggcgtaattccattgcgttcacacctatctatctcattttgagatgtatttgatctaaattatatattgtttatattgttttgaaaacttacaattaatttaaagttgtcagattttatgaccgataattaacggaaactgatcgggggagaggaattatgacttacaatcaaatgccgaaagcacaaggtctctaccgtccggaatttgagcacgatgcatgcggaatcggcttgtatgcccatttaaaagggaaaccttcacatgacattgtcaaaaaaggactgaagatgctttgccagctggatcacagaggaggacagggcagtgatccgaatacgggtgacggcgccggcctgatggttcagatccctgatgctttttttaagaaagagtgcggagaaatgagactgccggaaaaaggccgttacggggtaggaatggtctttttctcgcaaaatgaagaggaaagaaaaaagattgaaaaacaggtgaatgcattcattgagcgggaaggacagatcgttctcggctggagaaccgtccctgtaaatgtcggaaaaatcggaacagtggcacaaagcacttgcccgtatgtgcgtcaagtattcatcggcgccgcaaacgatttgaaagacagccttgcttttgaacgcaaactgtatgtcatccggaagcaggcggaaaattggggcgttcaagaacagcttgatttttacttcgcaagcctgtcaagccagactattgtttataaaggtttgttaacgcctgagcaggttgacgcattttatttggatttgcaggatgaaaccttcgtatctgcattctcacttgtgcattcaaggttcagcacaaatacctttccaacctgggaacgtgctcatccgaaccgctatctgattcataacggagaaatcaatacgctccggggcaacatcaattggatgagagcgagggagcagcagttcgtttcagaaagcttcggagacgatcttcacaaagtgctgccgattttaaatgctgagggcagtgactcatccattcttgataatgcgtttgaatttttcgtgatggcagggcggaaaccggcacatacggcaatgatgctgattccggaaccatggacggaaaacactcacatgtctaaagcgaaacgggctttttatgaatatcacagctctttaatggagccgtgggacgggccgaccgccatttcgtttacggacggaaaacagatcggcgccatccttgaccgtaacggcctgcgtccggcacgttactatgtgacaaaagatgaccatattattttctcatctgaggtcggcgttattgaagtagagcaggagaacattcttcataaaaaacgtctggagcccggaaaaatgctgctcattgacttagaagaaggccggattatttcagatgaagaagtgaaaacagaaattgccaatgaattcccttatcaaaaatggcttgaagaagaattggttcaagtgaatcctgacccggaaatccgggaagaggaacaattcgatgatcttctcgtccgtcaaaaagcgtttggctatacgtatgaagatattcagaaatatttaatccctgttattaaagaaggcaaggacccgctcggctctatgggaaatgattcgccgctcgccgttttatccgaccgcgcccaatcactgtttcattactttaaacagctgtttgcgcaagtcacaaacccgccgattgacgcgatccgcgagcagctggtaacttctacggtgacctggctcggagctgaaggcgatctgctgcatccgagtgaaagaaatgcacgccgcataaaattgtatactcctgtattatcaaacgaacagttttatgcgctgaaaacacttgtgcatcctgacattaagagccagaacatccgtacgctgttttccgatgacctagaaaaaggcctgaaggatttgtttcagcaggcggaaaaagcgatcaaggaaggcgtatctctgttaattttatctgacagggcaatgagtaaagagttgacgccgattccgccgcttttggccgtcagtgcgctgcatcagcatttgatccgccaaggactgcgaacaaaagcaagcattatcgttgaatccggggaagcgcgtgaagttcatcactttgcggctctcatcgggtatggtgccgatgctgtcaatccgtatttgacttacgctacgtataagcaggaaatcgatgaaggccggcttgatattccgtatgaagaagctgtcagcaaatacggaaagagcgtaacagaaggcgtcgtgaaagtgatgtcaaaaatggggatttcaactgtgcaaagttacaggggcgcccaaatttttgaagcggtcggcatcggtgaagacgttattgccaaatactttaccggtactgcatctcagcttggcggaatcgatatcgaaacgattgcgcaagaagcgaaacagcgccatcaagcggcgtacaaggatgattacagccaaacccttgatccgggaagtgaattccaatggcggaacgggggagagcaccacgctttcaacccgaaaaccatccatacgctgcaatgggcctgccgcaaaaatgattacagcctgtttaagcagtattctcatgcagcggatgaagaacgaatcggatttttacgcaatctgttcgccttcaaagaagaccgcaagcctttaaaattagaggaagttgaatcagctgcgtccatcgtgaaacgttttaaaacaggagcgatgtcattcggttcattaagcaaggaagcccatgaggctttagcgatagcgatgaacaggcttggcggaaaaagcaacagcggagaaggcggcgaggacccgaaacgtttcgttccggatgaaaatggcgacgacagaagaagtgcgattaaacagattgcttccggccgtttcggcgtaaagagccattatctcgtcaatgcggatgaattgcagatcaaaatggcgcaaggggcgaagccgggagaaggcggtcagcttccgggcaacaaagtatatccttgggtcgcggatgtccgcggttctacaccaggtgtagggctgatctcaccgcctcctcaccatgatatttattcaattgaagatttggcgcagctgattcatgatttgaaaaatgcgaatcgaagcgcgcgtatcagtgtcaagctcgtgtcaaaagccggtgtcggcacgattgcggccggtgtggcaaaaggcactgcggatgtcatcgtcatcagcggctacgatggcggaacgggcgcgtcgccgaaaacaagtattaaacatacgggtcttccgtgggagcttggtcttgcagaagctcaccaaacgctgatgctgaacggtttacgggatcgcgtggtattggaaacggacggtaagctgatgacaggccgggatgtcgtaatggccgccttgctcggtgcggaggaattcggctttgctacagcgccgcttgtcgttctcggctgcgtcatgatgcgcgcctgccatttagatacatgtcctgtaggtgtcgcgacgcaaaacccggagcttcgcaaaaaattcatgggcgatcctgaccatatcgtaaattacatgctgtttgtcgcagaagaagtgcgtgaatatatggcgcagttaggctttaagacgcttgatgaaatgatcggacggacagacgttcttcatgtcagtgaacgtgcaaaagcgcattggaaagcgggccagcttgatttatccacactgctgtaccagcctgaaggcgtccgcactttccgtacggcgcaaaatcataaaatcgaccagtcgcttgatatgacggttattcttccggcggtgcaggctgcaattgaagccggacaggaagcggaagctgaaatcaagatcaataatacaaatcgcgtagccggaaccgtgacgggaagtgaaatttctaaacgctacggagcggaaggcctgccggatgatacgatcagacttcattttaccggatcagccggacagagtttcggagcatttgtccctaaagggatgacgcttcatttgaacggggattcaaatgactacgtaggcaaagggctttcaggcggaaaaatcatcgtgaaagcgcctgatgccttcaattgtgaaacgcacgataacgttattatcgggaacgtcgcattttacggagcaacaagcggggaagcgtacattaacgggcgcgccggtgaacgttttgcagtccgtaacagcggagtcaatgtcgttgtagaaggtatcggagaccacggctgtgaatacatgacaggcggccgggttgtcgtcctcggcgaagtcggcaaaaacttcggggcgggaatgtcaggcggtatcgcatacgtcctcagtgatgatgccaaagcatttaaacgcaaatgcaacatggaaatgatttcatttgaaaagctgacggatgaggcggagatcaaagaagtgcaagaaatggtcaaacggcatgcggtgctgacaaacagcaaaaaagccgcagatctcctggacaattgggaaaaagccgcagaaacctttatcaaagtcattccgaaaaactataaacaaatgctcctcagcatcgaagaacaaaaagcggcgggtttatcagaagaagacgcaattatgtatgcttttgaagccaatacaaaggtcctccaaacgcctgccaaagatcaaaaacaagcggtagtacagtaagaaaggggagaggaacatggggaaaccaactggattcatggaagaaaaacgagaaaaaccggctgagcgggaccctctcactcgcttaaaggattggaaagagtattcggctccgttttcagatgaagcgtcaaagcggcagggggcgcggtgtatggattgcggcacaccgttttgccaaatcggcgctgatatcaacggttttacctccggatgcccgatttataatctgataccggagtggaatgacctcgtctatcgggggcgctggaaagaagccttggagcgccttctgaaaacgaataactttcctgaattcacagggcgggtctgtcccgctccttgtgaaggatcttgtacgctggctatttcagatccggctgtttcaattaaaaacatcgagcggacgatcattgacaaaggttttgaaaatggatggattcagccgagaattccagcgaaacgcacaggtaaaaaagtcgctgtcgtcggttcaggcccggcaggtctggcaagcgctgatcagctgaaccaagccggtcattccgtaacggtctatgagcgtgctgacagagccggcggtctgctgatgtacggcattccgagcatgaagcttgagaaaaatgtcgtcgaacgccgtattaaacttttgacgcaggaaggtatagattttgtaacaaataccgaaatcggcgttgacataacggcagatgagctgaaagatcaatttgatgccgtcattttgtgcacaggcgcccaaaagcagcgcaatctgctgattgaaggccgggaagcaaaaggcgtccattatgcgatggactatttaacactggcgacgaaaagctatttagattccaacttcaaagacaaacaatatatagacgctaaagggaaagacgtcatcgtaatcggcggaggagacacaggagctgactgcgtggcaaccgcgctgcgccaaaaagcgcgcagcgtgcaccagttcgggaaacatcctaaacttcctcaaacgcgcacgaacgacaatatgtggcctgaacagcctcacgtctttacccttgaatacgcctatgaagaagcgcaggcaaagttcggcaaagacccgagagaatattcaattcagacgacaaaaatggtggccgataagcagggccgcttacaagagattcacaccattcaaatggaaaaagtcagaaacgaattcggaaagtatgaatttcatgaactgcccggaacagaaaaagtctggcctgctcagctggtgttcatcgccatcggttttgaagggacagaacagccattattgaaacagttcggtgtcgattcggcaaatcataaaattcaggcggcatatggggattataaaacgaatgttgacggtgttttcgccgcaggggatgcgagaaggggccaaagcctgattgtatgggcgattaatgaaggccgggaagcagcgcgcgaagtcgatagttatttaatggggagcactgttttaccgtaaataaaggggtttatttataaaaccggctgggatcagccggtttttcgtattgaaatgaaacctccttcttcctttattggtcatataagggtaacgtggaagataacatatggaattttgttttacagagtggagagattgttttcttccgcagactgagacgatttgcaagccttgagcagtcgatcacggtgctgctgacgggctctgtgtgtctgcagtcgatttgcgggcagattttaattgatgaagaaaaacatattgaatttcaagcggaaacgcttataaacaaataaggaacggacgcgtccgctcctcttttttagacatccaaacgaaagccgatattgccgaactgccgtccttcccgcattctgttaaaagcggcagctgcttcactgagagggtacatgcggtcgataatgggacggatgccgcagcggtttaccaattccatcatatccgcaaattcctcattgcttcccattgatgtaccgagaatatgaatctgcggaaaaaacagcgagcgaatagggaatccgagctgatcgcctgaactggcgccgaatgttacgatccggccattcggtttcataatgtcaagatagtgttgaaacaaggcggggcctacaccgtcaagtatgatatctgctttttcgccatacagcgcctcattccagtcaccgtagctgtcaatcgcccggtctgcaccgtatgacagtgcggtttgttttttgttttcactgcgggaggtgacgctgactgtcgctccgatagcttttgccattaataaggcgtatgttgccacgccgcttccgatgcccggaaggataaggtgttcgcctttttttaattgtccttttgtaaataaggcgcgataagcggttaatgctgataacggcagcacgcccgcttcctcccatgtcaggtgttcgggttttaaaacggcattttccgcaggaacgatgacataaggtgaaaaggttccgtcgctcggaccgcctaaaatatcaggtacggccggtacgtcctcaacggtcttccaattcagcaccgggttgatgatgacttctgcatgcagtaaatgagaccggacgccgtgtcctatttcggttacgattcccgcgccgtctgaaccgagagtaaattcatggtttccggtttcgtggtttttcattaaaaacaaatcacgatggtttaatccggctgttttcagctttatttttacttcgccgtttcccggccttttgtcaggtgcctgcctgaaatcaaagccattttcgtgtatgataagggcattcatcattcttctctcctttatgattgatgagaaagattttacaggctgtatcagctgcagtaaataaatgaaaattgatagccggctatcaataaaaatcatagcaagaaggtgcccttacatggaaagcggagacttaaagatttttcaggctgtcgcccgcaaaggaagtatttcaaaggcggcagaaagcctgcattatgttcaatcaaatgtgacaaaccggattcagcagctggaacggcaattgcaaacacagcttttttacagcacaaatcgggggatgacgctgacgcccgcaggtgaaaacttattgaaagacgcagacagaatccttcaattgttgcatgaggcgcaaaaaacggcgcaagaggcaggcgatccgaacggcccgcttcgaatcggttctcttgaaacggcggcagccgtccatctccctcaatttttcacagagtattgcagccgctgcccgaaagtacagctgtctctgtcaaccggtgatacacataccttagtgcagcacgtcttacactatgagctggacggcgcttttgtttatggtccggtcgaatacgaagatcttgagcaagtcgctgtaattcaagaagaattggtcttggtttcaaataagcgggaaggcagtttgcaagacttgttgcgagatccgattctgtattttgccgcgggctgttcgcaccgccgcaaaataaaaaacatactgaaagaagaagcagtgcccgcacataaaatcattgaattcggtacgttggaagccattattggggcggtgcaagcggggatgggggtttcctttctgcctgcatcagccgtccgttattttcaaaacaggaaaaatctttttcttcatgagctccctgaacagtttcgggatatgaatatatcatttatctaccggagtgatttatttttgacatcggcgtttgaagaactgctgaatggattaaaaactttaccgaacggaagatgagaaaacaggacagctgtgtacgccaatttttttcgttctggtttttctcaaaagaaagcgggtatccgggctgagcttgatcagcgcgatgaaaaactcggctattaaatcagagaagcacaaatgaaaaaaataccgtatattgctgttgtgggagatcgagagtgccgccatcaatctgtacatgtaaggcaatacgggcgggaagacacatttgaagagaatgtgagtgattttatttcccggatcataagagaggcaaaacaaaaaatagagatttaacaaaaacaacattgacatatcgtaaaatcacgatataataaagcgtatgaaacctattgatgtttttaaagcgttgtctaatgagtcacggcttgagattttacaatggctgaaagagccggaccgtcacttcgccccgcatgatggcattgatatgaatgagatcggagtatgtgtcagccagatcaccgataagcttcagatgacacagtcaacggcgtctcaatatctttccatccttcagcgggcgggccttatccaaacaaaacggattggcaaatacacctattataaaagagatgaagaagcgataaaggcgatggccgattattttcagcgcgaaatgtagggctgaatcctttagaagagggattcagtttctttttccgactacacatcgacatattgcgatttgtttctgttttcaactctttatatcgatatatcacaatatatctttatataaatcatcaatgaaggagtgtgtcaggtgcaaaatacctggaagatttacattttggcaattatcagttttttagtggggacgtctgaatatgtgatatcagggatgcttgataaaattgcaggttccttgggagttactgtggcagcggcagggcagctgattacgattttttcacttgtttatgcaatcggaacgcctgtcatgatggcccttacagcaaaactggacagaaggaagctcatgatctatgctctggggctgtttgttatcgggaatatcatttctttccttgtgcagggattcggcttatttgcgggagcgcgggtgatcatggcgcttggagcaggaactgtggtggtcaccgcgcttacgatcgcagcaaaaatcgctcccccgggaaaacaggcaagttctctcgcaaccgtcattatggggtttacggcggcgctcattatcggtgttccgatcggaagaaccgtgtctgaagcttttggctggaaggtggtttttgccggaattgcggcaatcggaatcattgccatgcttattatacgtttcgcgttgcctgagataaaaggagataaaccggtgccgctcattcagcaattttctcttttgaagaaacgaaaggtggctgtcgggctggccattacgtttttttggctcggaggctattcggttgcgtatacgtacctttctccgtatttactgaacgttactcatatcggaagcggaatactgagtacattgctgcttattttcggtgttgcaagtcttgccggttctaaagcaggcggtttcagcgcagacaaatggggggcgcgtatgacattaaccggcggaatggcgcttcatgctatcatgctcatgttattgccgtttgtcacacattctgctttcggagcggcggcagtgcttattttttggtccttcgccgcctggtcatctgggcctgctcagcagtatcatttggcaacgatggagcctgaatcatcgggtgtattacttggcctcaaccagtctgtcatgcagctggctatggcagccggagcgggcatcgggggcattgttgtcacccatctgtctcttgcgtcagtgacatggatcggatcagcgggtgttgtcatcgcgatgtgcggcgtgctttcgcttgcgtcattaacgtctgaaaaaacctcatctgaatacagtgcagaataaacaaaagcctcatttctcagcttgagaaacgaggctttttgtcttgtcatttttcacattttttcaagtttacgccgattgcggctccgtttcggcttgagtcggcaactccggtgaaggtgccgttttcacggtcgatcaggatgctttgcacattcccgatatcaaccgggctgctgccgaatttatgccccatttcgttcagttttgtgcgggcttcttccggcactcctttttcatatcgataggatgtcatgctgtttgtgtaaattctcggctcttcgaccgccgctttcagatccatgccgtactcaactttgttcaggatcgtttgcaggacggaagaaataatcgttgctccgccgggggagccgacagtcaggacaggttcgttatttttgaataaaatagtcggagtcatgctgctgagcggacgtttattcggctgcacttcatttgcaccgccaggcaccgcatcgaagtctgttaactcattattcaacacaacgccgtatccgggaaccataatgccggaaccgaacagctgttcaatcgttgtcgtataagatacgacattgccgaagcgatcagttaccgtgaagtgagtcgtttggccttcttgtttgtcagtcggctgctccacttgtttatagtttgcagaaccttcctgataggcccaagggtcgccggctttcggttttttattgactttatcaatatctatcagctgtctgcgggcattgatataatctggattcaagaggcctttgagagggacgttgacgaattctggatccccggcaaatgcggcgcggtcagcataagccaaatgcatcgtttctgcgagaagctgatatttttgccaagaacggatatcatattgagaaagcttaaaatcatccagaaggttcagcatttgcaacaggaaaacaccgcccgagcttggaggaggagcagttgcgatatgatagccctggtaatctccccagatcggttcgtcaatcgtcacattgaagtttttaatatctttttctgtcattgagccgccgaattcctgcactgtttccgcaagctttttggagaatgctccgtcatagaatgcttttgtgcctttgtacttaatagctgtaaatgttttggctaagtctttttggatgagtgtgtctccttctttcagaggttctccgtccggaagaaacacgtcttttgcagcagtgtgtgataatttgtctttataatctgagatggcatcagctaaaaccgaatcgatcggaaagccttttgaggcaagtttaatggaaggggtgatgagttgtttcatggagcgtgtgccccatttgtcgagcgctttttcaagtccttttaatgttcccggaacaccgactgcagtccctttcgtaacgcgttcggagaaagggatggctttgccgttttcgtcaaggaacatatccggtgttgcgcctgccggtgcgcgttctcggctgtcgataatggtggtgtctttcgtcttcgcatcataaaccatcataaatccgccgccgccgattcctgacatcataggttcagttacgtttaatgcgaattgaatggcaaccgcggcgtcaattgcattgccgccttttttcagcacgtcggcaccgatttgtgaagcgagagggtgggcggtggcaaccatgccgtctttgccgacatctacctgtttgtagtcgtcataggaaaacgggtgtttcttagcctgagcgtgataagggatgcttccggccgcgagcaacgtactgagcagaacgataaaacagagattcataaactttttctttttcatagtctgcctcctttgttttccgcttacaattatagagtaagtaaaatgtgctgttttcacaagtgacaaacggaatagtccggtgcgcaaaaagccggagtttctgtgtgaatgtaatcagtcgcaaataggctaaatgggaaaccggactgaaaaagctgtgaaacaagcataaagacaaaaaataagctacaatgaacaaaacagaattcactcacatgacatatgaaaggaacgtgagccatgtatttaacgatcaaagagacagcggagtttaccagtcttcctgaagaatatgtgcacaatcttgttttgacgaataaaataagggccgtccatgacggacagcaatatttaatcaacaaggaacaatttcaaacccatctcgagcagttggaaaaatacaaggaaatgattcaagagtttttaaatgagccgcttcctgaagacattgatgtaaaagatgaagactaggacacaatttcatattgtgtcttttttttgcatttttttcggttgctcacaaaaaaacggatgctcagatttcattttaaggccgttgttttcattttttaatgccttgagtctctatttgtttaaaagcttgtcaccggtctgaaaatgatgtttttgaggaatttgttgaaactgcgtatctgattcaccttatgtaacactatgtatattatgttacataagaccctttatcctttatcattcaacgggtttcggctataatagtaacataatgctcaatatgttactttactattataaggggttttttgatgcatatcgtacagccgatccgaagtttggagaagatccaggaagtcaaacagtatttaatgaagaaaagtgatcgtgattattttttatttattttcggcatgaacagcgcactgcggatttctgatgttctgccgcttcgcgtgagggatgtaaggaacaaagaccacgtgtgggcaaccgaaagcaaaacgagaaagaaaagaaaaattctgatactggagtctttaaaggccgacatatacgcttatacaaaagacatgaaagaagatgactatttgtttaaatcgaaacggacgaataagcccatatcccggattcaggcatacagaatattaaaggaagcggctgccgcttgcgggttggaggaaatcggaacgcacacgcttagaaagacgttcgggtatcatttttatcagaggacaaaagacattgctgaactgcagaggattttgaatcattcttctccgtctattacaatgcgttatatcggaatagatgaagatacgacgagagccgcctataaagtgttcggaggactgtaggcttgaaaaaaacggccgccagcgttactataatagaagcaggctctagtagcacagcggatagtgcagcagtttcctaaactgcaggtcgggagttcgaatctctcctagagcgttttttgtatgagataggcgcagcttaataatgtcggtaaaacaaaaacccccttgttatacaagggggttttgagttgaatattttgtgagaacctggtggaaatgatgtgaaaaaagcccgctgtaagcaagcgggctttttcttatatgacagcatcaaattgattgactttccaaacgttgttttcttttacgaatgttacatcgcgttttgctgacggagaaccgtcaagagtcggtacagtgaagcggtatgtttggacgcttccttttttagaaagaagggtcatttttgcttttttccaattcaggaggttatctccatcgccgaccggaacagccaatttgccgtcttttacagtgaagtggtaatctttgagccctttgtcaatcgcttgctttgtaaaagcgggtgtcagatattttacggctttcgcttttgttccgaggtctttgcacataaatacatattgcagattttgatattcaaacggttcagatgtgcaatttgcgtttgatttaagcgcaccgccgctcattgtattccagaaatgttctctcgctgacagggccagctgaagtgcttgtttttgtgtaaggtcattaggtgcattttttgcagtcgccgcagtgcccaatgatagaatcaatgtaatagtagtgaggaataatagccattttttcatgatataatctctccttcaatcaatctctttctcttatgttacaaatgttacaataattacggtaagattacaataccttttcagaaatattttccggactttttatttttatggtttatttccatgtaagacgtgagaaaaagataaagagtttcattgaacaaaaggtttttacaagctgtctgctgaataataaaatggaagaaaatcaaaaaaggagtcctacatatggaagtacaagatcatttagaaacagcggaaggccgcggccagtcagtctggcgatcgatgtcactgtttttagtgccgctgcttttaagcaatgtattgcaatctgtcggccaattggtcggaatggtatttgtcggaaggtggctcggagtcgatgcgcttgccgctgtatcgtctttttttccgctgttttttctgctgatctcctttacgatcggaatcggttcggggagttccattctgatcgggcaggcttacggcgcgaaaaacgaagagaggatgaaggcgattgtcggcactacactgacttttacctttatgctcggtgttgtcctggcagttgtcggcagtgtgtttacgcttgatattctgcggctgatgggaacgccggaaaacgtaatagatgtcagtgtccgatatgcgcgcattttgttttgcgcaatgccgctgatgtttttatattttgcgtatacgacatttttacgcggaacgggagattcaaagaccccgttttatacgttaatcgtcagtacagtcataaacatcgggctcttgcccttattgattctcgggcttttcggacttccgaagttcggcatttacggttcggcgtatgcaaccgtgatttcaaacatcgtgacatttatcgtactcatgatttatttgcggaaaaggaaacatccattggcatttgaccggactgcgctccgttctcttaaaatggacaaaaagctgctcgcgcttttactccgtctcggtattccgtcgagcatcaatatgattctcgtgtcactttctgaaattgcggtcatttcatttgtcaatcattacggatcaaacgcgacggctgcttacggggtcgtcaaccaagtggcgagttatgtgcagatgccggcggtaagcctcggtatcgccgtttccatttttgccgcccaatccattggcgccaatcaattcggccggctgaaacaggtcatcaaagtcggcatcggcctgaattatttgatcggcggggttttgattgtgctgatttacaccttctcccggcagatacttgctttgtttttaacagatcaggatacactccacattgcccgcaatctgattatgattaccctttggagctatttgattttcggtcacgctcagatcgtttcagcgacaatgcgggcgagcggtacggtgttatggccgacgattatcagtatttttgcgatttggggaattgaagtgcctgtggcctttattctttctcattatacgaatctcggcattctcggcatttgggtcggttatccggcggcttttgtcgtcagcctgctgctgcaatacggatattaccggtttgtatggaagaaaaaacagattacccggctgattcaataaggttttaccgcacatcgctcagttcatacgggcgatgttttttttagagaaggaaaatgagtttagaaaatggaattcctatacatgtagaaaacaaggaaagggcaggtgcttatgacgattgaacatacgacttatttaggggcttcagccataaaagcggagactgatcaggctgaatgcatcattgtgccggagtggggatcaaatgtcatatcgcttcgggataaaagaaccggtatgcggcttctgagagaaccggaaactgcggagcaattccgcaaaaaaccgatgctgtacggcattcccgttttattcccgccgaaccggattacggatgggacgtttcgttttgacggccgcgcgtatcaatttgagataaacgaagaggataaacataatcatattcacggctttcttcacaatcagcattggaaagcggcggcagcgaaagaagagggggatggaatgacagtcgaaacagaaattgatctttcaaagattccccgtgttcataaacaatttccgcacgatgtcattgtccggatgacctatacattaaaagacaatgtgtttacgcagcgggcgctgattatgaataagggaacggaggcttttccttgggggctcggctatcattcaacttttgttttcaatgaagagcgatcccgtctatttttgacggctgaccgcatgtgggaattaaatgaacgtttcgtgccgacgggccgtttattggatgtgcctgataaagaagcgttccgtcagggggtgtctttgaaaaataaacagtttgacgatgtttttctttcttccggacggaatggcggcaataacgaagctgttatttatcatccggatgagcaattatccgtgctgtatcaagcagacatgtctttcaagcattgggtggtatataacggtgacggaaagcaagggtttgtcagtcttgagccttatacttccgttacagatgcatttaatctgaatcagcctgcatcactgacagggcttcagattctgaaaccgggcgaagaagcggctgcgtcatccaggatcaccattttgcatgacgaagaataggaaagaggcgggataacattgaaaacatatgtgaaacgcttgagcgcggtgattctgcttttggtcattgccgcagttccttatattgatgaggcggctaaggcggctgaacaaaaaaatactttgcaaaaagagctggaacacattctggatgaagaacctgctttaaagggagtttcagcgggcgtcagtgtccggtcagcaaaaacaggggaggtgctgttcggcagccgggaagatatgcggctgaggcctgcatcactgatgaagctgctgacggcatctgcggcgctttccgttctcggagaagattacacctttaagacagaagtacgggcagacggcgccgtgaaaggaaaacagctgcgcggaaacctttatctcaggggaaaaggcgatccgaccctattggcttctgattttgagaagatggctaaacaggtcaaagccagaggcatccatgtcattaaaggagatctgatcggggatgattcgtggtatgacgataccaggtattcagttgatcttccgtggagtgatgaaggccaatattatggcgcgcaagtatcagctcttaccgcttccccaaatgaggattatgataccggaacggtgattgcggaaatcagcccggcaaaacagcccggtaaaaagccgcgcatttcgatttccccccatacggacgtcgttcgtgtgaaaaatgaagtgaaaaccgtcgcttctgatgaagcgaaagaattgacggttgaacgggagcacggcggcaatgtgattacgataaagggaaccatacctgccggctcggcaaaggcaagagaatgggcggcggtgtgggatccgtcgtcctatgctttagatttatggaaacaagcgcttactaaacagggtataactgtaaaagggaaaatcagaacagggcgaatgccgcaccgcacccagcttgtcacatcacggacatccatgcctctttcagaattattgatcccgtttatgaaactgagcaacaacgggcacgccgaaattctgatcaaggaaatgggaaaagtgaaaaaaggggagggcagctgggaaaagggcttggacgtgatgaaatcggagctcaaatcgttcgggctcaatccggataaattgattgcaagagacggatccggcgtttctcatattaacggcgtatccgccggtcaaatcggagagcttttgtatgcggttcagaaagaaaagtggtacccggctttccttcgttcgctccctgtcgccggtgcaagcgacagaatgacgggaggcactcttcggaaccggctgaagaatactccggcagagggcaaaattaaagcgaaaaccgggtcactaacatcagtcagttcgattgccggctatgcagacacaaaaacaggagatacgcttattttttccgtgcttcaaaacgggctgcttgacgaagatgacggaaaagacattgaagacaaaatcgcagtcgtgctggcaaatcaataagaagggccgaatccttagaggattcggctttttttgatgtctgtaaaacattatattgcgattatgaatcaatcttttcaaaaagtaatatcggcaatacccttccttttttttacataccgctttcttacatgttcaccgattattcattttttaacataaaacttcttttcgggaggaaaacctttttaaaagcgcaattaattatacattttattccttattatagtgtttaagaaccagtttacagtatgcatacataccgttttacatggtataaagattatagaaatgaagaagtgaagtgaggaatatatactatattctaaaaaatgttagagaaaatttaattttttattgtgatttctaaaatatgttttaaaataatgcttatatggatgattaagtcatatgctgtcgaaatttaattgtaattatttcactttcttatcctcttaaattgaagcggagggattccattggagaacactgtttattctttaactcacgcacaaagaagagtgtggtttacggagctgctcgaaccgggcacaagtatctgcaatctcgcggcatgtgtcaaattcaggggggacatcgattttgacgtactgcgccatgctttagatttttctatctcgcaaaatgattcgctcaggtttcaactgacagaaggggacggatcagaaccccagctgtatctggcggggcatcggccgatttctctagagactgttgattttactcatactgatcaggcagagcgggacgcatggattgacacgcagacccgtgttccgttcaagctgtttcattcacctctgtatcaatttactctgcttgtcatgtcagacgaagaagtttggctttattcaaaatttcaccatattatcatggacggcatctcgctcaacctgctcggcaaccagctcattgatatctaccaaaagatcatgcggagcgaggatttagctgaacatcacaagccttcctatctcagctacatggaaaaagaacagcaatacttacagtcttcccgttttcaaaaagaccgttcattttggactgaaacataccgaaccgttccggaacacctttcactggcggaacgaacctctcatcttagacaaagcactgcggcttccagagatacaatcactctttctcactccttagaacaatctatccggcgtttttgcaaagaaaataatatcagcatcatctctctgtttatggcttcgttatacatatgcatcagccgtctgacggctaaaaaggatattgccatcggcacttattacggaaaccggggctccaggctcgaaaaggatatgctcggcatgttcgtcagcacactgccgatcagaatgacggcagatcctgatgcagagttcctgtcctttgtccgcagcgtaggaaaagagcagctgtctgttatgcggcaccagaaatatccttacaatctttttgtgaatgaattaaggcagactcatcatgacctgcaaaatatcatcggtatttcgatgcagtatcagccgcttgagtggcgtaaggcagacggtttcgattatgaaacggccatgtttttcagcggacataccgcaaacgagctctccattttaattaaggagcggacagatacgggattgattgagctgaattttgattaccaatccgctttatttactgaaacatcaattaaacgcattcaaactcatttgctgacgatcgttgaaaatgccgttagaaatccagaccggctgattcggcatattgatatggcggatgaaaaagaaaagaaacgggtgttatcttcgtttaaccgtacagaagcggttgaaccgccggctccgacgcttcacgggctgttcacccgccgtgccgcgctttcgccgcatcgtccagcgcttcgttttccgggcggtatgctgacgtacgccgagcttgaccagtacacagacagactcgctgtttggctccgacaaaaaggcgtccgcaaagaaagcatggtcggcgtgctcgctgaacgctcgccggagatggtggtttcagtgcttgccgtgttaaaagcgggcggcgcctacgtgccgcttgacccggagtatcctgaggacaggctgcgctatatgctcgatgactgcggcgcttgtctcctgcttgcacagccgggattatccgtttccggtttttccggagaaacgctagaagtgtctctttctgctctgacaggcgagacggagacaggggctgtctctgaagaagcggatagcgattcgctcgcttatatcatttatacgtccggttcgacgggaacaccgaagggagtggctgttgaacaccgtcaggccgccgcctttttatcagggatgcaagggcagttcccgttgacggaagaggatattatcgttctgaaatcatccttttctttcgacgcttccatctggcaattgttttggtggacgatgtccggcgcctccgtgtatctgcttcctgccggctgggagaaagatcctgtgcggatgattgaagcgtttgcctcagaaaaggtgacgaccgcgcattttattccggcgatggtcaacagctttttagatgcgctggaaacagagcctgcggaaacaagaacacgcctcggcagaaccttgacacgcgtgtttgccggaggggaagctctttcaccgcttacggctgcccggtttgccgatcttctgccggagaccgtgctcattcacggctacgggccgacggaagcgacggttgatgcggcgttttacgtctgtgaccgaaaacgggacagcggacggacaaggcttccgatcggaaaacccgttccgggtgcccgtctgtatgtattagatagcggaggaaccatccagcctgcgggcgtggcaggagagctgtacatcgcggggacaggggtggcccggggctatctgaaccggcccgagctgacggaggagcgttttctcgatgatccgttttatccgggagagcgcatgtatcagacgggcgatatcgcacgctggacagaagagggcctagtcgaatggctcggacgttcagacggacaggtgaaagtccgcggctaccggattgaaccgggagagatcgaagcggcgatccggcgcatcgacggcattcgtgaggcggcggtcaccgcccggaccgaacacggcgaaaccgcgctttacgcctatatcgaaggacgggaaagcgatgacgtgcgggcggagcttgcgacacgccttccggtctacatgatgccggctcagtttatagagatgagcgaatggccggtcacgccgagcggaaagcttgaccgccgcgcgctgccggctcccggcggagcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggtcattcaggatttggaagagagcccgtatgaagcgattcagcctgcgaaaaaacaggacacctatccggtgtcttcggcgcagaaacggatgtatgtgctccagcagcttgaagacggcggtgtcggctacaatatgccggctgtgctggaactgacgggcccgcttgaccgcatccggctggaggagacgttccgggagcttgtggagcggcacgagtcgcttagaacgtcctttgaaacggggcctgacggcgaaccggtgcagcgcatccatgacagcgtgccgtttcagctggatgaggccgagtcagctgacgcattcgtccggccgttttgtctggaggaagcgccgctcttccgtgcggctctcgtgaaagaatcagacgaacgccatctattattaacggatatgcatcatattatttctgacggtgtgtccgtcaacaccttgattaaagaattcggcgagctgtacgcaggccgttcgcttgcgccgatgcgccttcaatataaagactatgccgtctggcagcggtcatttcaggagaaagaagggtaccagaagcaggaagcctattggctgaagcggcttgaaggagagcttccggtgcttgagcttccggctgacaagccccgtccggctgtcagaagctttgcgggcggcagcgtatcgtgcacgcttgacgctgaaacggcatccggccttcaccgcatcgcccgggatcacggctccactttgtatatggtgcttctcgccgcgtacaatacgttactcgcgagattgagcgggcaggaagacatcatcgtcggctcgccgattgccgggcgtccgcacaaagaccttgaaccgattctcggcatgttcgtcaacacgctggccatcagaacggagccgaaaggagacaaacggtttaccgattacttggcggaagtccgccaggcggcgcttgaggcgtatgagcatcaggactatccgtttgaagagctggtggaacggctcggggtgcagcgggacatgagccgcaatccgctgtttgatgcgatgtttattcttcagaatatggagcgagaagagataaatctggccggtctgaaggtgtcacgatcagaacataccgaacatgatgtatcaagttttgacctgaccttatcagcggctgaatccgatggaaacatccgctttgaaatggaattcagcaccgagctttttatgaaagaaacgattgaacgctggatgggccacttactgaatctcttgcgccatgttgccgccgaaccggaagtcacactatcgaaagctgacattttggatgaagaagaaaaacaaaagttactgattgagtttaataacacacaaaccgaattcatggaaaaacacaaactgtttcaccagttgtttgaagagaaagcagaagaaacgcctcatcagaccgctgttattgaaggaacacaacagatcagctattcgcagcttaatgagcgggcaaatcggcttgcgcgaacattacacaaatatggattcggtccgggaaaaagagcagctatattggcaaaccgttcgattgaagcgatcgtcagtgttcttgccgtcatgaaatcgggaggggcgtatataccagttgactcccattatcctgaggaacggattcgctatttattaaaagacagcgcggcatccgtcttgatggtgcagtcagaatacaaagaacttgcttcacagctgacggatcacaatttatttctcattcagcttgatcatgaagatcaatacgatatttgtgcaaagaatattcagccggcagcgtcaccggatgatactgcatatatcatatatacttcgggaacaacgggaacgccgaagggagtcgaagtcagaaatcgcagctttacgcatgcagcacttgcatggcgcaggatttatgagcttgatcttataccggtcagagtgctgcagatggcgagtttctcatttgatgtattttcaggagatcttgcacgcgccctgctaaacgggggaacgcttgtcatttgtccggatgacgtccggcttgagccgcaacagctttatcggctcattgatcagtaccgtatcacgtttatggagtcgacacccgcgctgattgttccgtttatggaatatatatatcgccggaagctcgcgctgcaaagtgtaaaaatactggtactgggttcagatatgatcaagtcgcaggatttttatacgcttcatgaacgcttcggaaaagaaatgcggatcattaacagctacggtgtaacagaagcgacaattgattcttcgtattatgaagccgaaatgagcgaaaagccgcaggaagatgatgtgccgatcggtgttccgcttccgaatgtacaaatgtacgtcttaaacaaagacaaacaggtccagccgatcggcgttttcggagagctgtatatcggaggggccggcgtcgccaaaggatattggggacagcctgagctgacagagggcgcattcagtgacccgttacaaacgggagaaacgctttacagaaccggagatcaggcttgctggctgccggatggtactcttcgttttcaagggcggattgataagcaggtaaaaatcagaggctacagaattgagacgggagaaatagaaagtgtgcttttgaaacacgatcaagtcaaagaagcggctgttaccgtgatgaaagatgccgaaggacaagcccgattagcggcatacatcgttcctaaagaggccgatatctcatcacttcgccagtctctaatgcaggagctcccggcttatatgatgccgtcccatattatcggtttagacagcatgcccctgacactgaacggcaaacttgataaatcggcattgccggcagaagagatacattcatcccaggcatttgtcgcgcccggcgatgaaaaacaggcgatgttatgccggatttgggaagatgtgcttcatattcagaaagcgggaatccatcactctttctttgagcttgggggagattccattaaggcgcttcaagtgtcagcccgactcgccggagaaggctggaacatgtcgatccgcgatttgtttcaattcccgacgattgcagaactcgcgaagcacctcacgccggctgttgcaactgctgatcaggggccgatagaaggaagcgctccgctgacaccgatccagcagagattttttgaggagccgggtgcgtttgagcttcattataaccaagcggtcatgctgtgcagtgaagacagcctcgaaatagatgcgctgtatcaggcggtttgcgcgctgaccgaacatcatgatgcgctgcgaatgactttcactgaaaatgagcatggggaaacggttcaatataatcgcggaatcacaaagcagtatgaagaaatatttacgcttaacgtcatagatatttcagaagaaacgcagcccgaaaaacggatagccgctgaggaaaaagaaatacagcaggctatgcgtcttgatcaggggcctctgcttcatctcggagtgttccgtcagaaggaagccgaccatcttcttataacgattcatcatcttatcacggacggcgtgtcatggaggatattgcttgaagatctgcagacagcttatcagcaggcattggacggcaaacaaatcgaactgccgccgaaaagcgattcttatataaagtatgccgaagaactttttgacatttccaaaagcaaagcattgctggaggaagccgcatactgggacagcgtgatgtctagtgaaacagcgccgctgccgaaaataactgatgaaaacgccggacgattgcaggaaaacgcgcgcactgcatcgtggatattaagcagcgaagtcacgaaacagctgctgttggaaacacagcaggcatacggaacggatgttcatgaattgcttttaacggcgcttggaatggcgcttcatgagtggacgggttctgaacagatccttatcagcactgaggggcacgggcgccaggggcatatgcctgacattgatatgtcaagaacggcaggatggtttacatctgtttacccggtgcttttggatatgagagtgtcgggaggctcaggcgaaaaaaccgctcaccgcataaagacggtaaaagacatgatgagacgggttcctcatcacggaaccggctacgggctgctgagatattcgcgaaacattctttataaagacccagaaataagctttaactatctcggtgcgtttgacggtcttgaagggacactgaagatgtcaccgttcaagccgcagcatgatatagcggccgggcgcatccgcgaatttgatctggatattaacgcgatggtggcggccgggcaactggaggtaaaagccgtttataccgatgtatttgcaccgggggcaatcgagttcttcatgaatcgtttccatactcacctcgaggacatcatcgcccattgttccggcaagaaagagcgggaaaaaacattaacggattacagccatacagaattgaccgctcaagcactatcaagcattgaagatctcgtaaaaggactttaatttcataaaaaggtgtgtggcattcgtgacacaagcgacagaaattcaagatatttaccctttatcatatatgcaggaaggcatgctgtttcattcgcttctggattccggatcaaacgcatatgtcgagcagatttcgtttacggtcagcggggatttatgcattgatacattccaaaaaagtctggatatgcttgtcagccgttatgatattttcagaacgattttcataaaagaagtgcctgaccttgaaggaccgcagcaggttgtcctttcacgccgtgacacagccgtacagactgagaacatttcagactattcggaagaacggcagcaaagcatcattgacaaattcaaggaaaccgaccggcataaggggtttgatctgcaaaaaggccccttaatgcgcctgactctttttcaaacgggagaaaaccgtcatacatgcgtttggactcatcatcacattatgatggacggctggagcttgggaattgtactgaaagatttcttcagcatgtattatgcgatccgaaacgggcggcctgtaaacctcggcagtccggctccttacagcacttatatcaaatggctccgaagccggaataaagaagaaacgtcagcgttctggtcgcgctgcttggaagattacggagaaatcgtttccgttccgcaaacgaagaataagccggcgcagaacggttatgcatctgagcattttcaattttcccttgagtctgaaaccgtgcaaaaactgacagacattgcccgaagcacaggggtcacgctgaatactatatttacgggcatttggggcctgcttctccatcgttacaacgggactgaagatgcggtcttcggttcggttgtttccggcaggccgtcagctatcgccggcattgaatccatggccggactgtttatcaataccgtgccggtaagggtgcgcgcggctggtgatatgactttttcttctcttctcaaaaaggtgcaaaaagagtcactcgctgcggaagagcacagctattatccgctttatgacatccaaaacgagagcggcctgcaaaaagatctcttgaaccacatcctggtttttgagaattatccggttcagatgcagactgcggtaaacggctggcagcaaacggaaagcaatgcgctctcccttgaaaacttttcgatggcggaagaaaccaattacgatcttaacgtcgtcatcgttccgggagaagagttttatgtgaaattcagctacaatgcgggcacctacgatcgggaagacatgaaacggatcaaagggcatattctggaggtcatctcctgtgtaacggaagatccggacaggcttttatcaagcatcagtctcgtacctccggaggaagaagccctgattcattcgtttaacgaaacgaaccgtccgtaccctgagacaaccgttcatgggctgtttgaagaacaggcggcaaaaacgcctgaccaagaggcgttgagatataacggggtaagctggagctacaaaaaattaaatcagcgggcgaatcagattgcccatgcgttaagggaaaaaggcgcccgttccgatcagatcaccgctgttatgctgcgccgatcaatgagtacggttgccgctctgctcggaatttggaagtcgggcagcgcctatatgccgattgatgcggaatttccgcctgaacggatttcatttttactgagagacagtgaagcctcactgctcgtgactgaaaaagacctgctccccctcattccgccgcatttcaagggcagcgtcgtcatcttggaggaaacggtttcccagcagaccgcaccgcttccgccggtatctgacagcggaaattgggcgtatgtcatttacacctccggaacgacaggccggccgaaaggggtgcttgtacaacacaaagcgatcagcaatacattgcaatggcggcgtgaagaatacgggatgacagaaggggacatagcgcttcatcttttttcatacgtatttgacgggtcattaacgagtcttttcactccgcttctgtcgggcgcctgtgtattgttaactgatgaagatgatgcgaaagacgtcctttcaataaaacagaaaatcacccgacacggagtgagccatcttctgatcgttccgtctctgtatcgcgttctgcttgattcgctgacgaaaaaggatgcgcagacacttcgggcggtgacatttgccggggaagcggccactcctgatatcgtggaagcgagccgcggcatatgcccgaatgccgagctgctgaatgaatacggcccgacggaaaacagtgtggccacgacgattctgcgcaacctgcaaaaaagcagccggattacgatcgggcgcccgattgccaacacttctgtctatatgatgcacggagatcggctgcagccggtcggagccgtcggtgaactgtgtatttccggaaaaggtctggcggacggatatttccagcaaaaagagctgacggacaaagtctttacccctcatccgtttcgtgaaggtgaacggctgtacagaacgggagatgcagcccgatttttaccggatggaacgattgaatatatgggacgctttgacgatcaggtgaaggtaagaggttacagaattgaattaggagaaatcgaaacggcactcagaagtctgtccggggtaaaagaggcggcagtcaccgtgcgcaaaatggcggacggggaacaggagcttgcagcttatgtcgtactggaaaatgcgggtgtgacatttaaaccgcacgctgaattggccgggagattacctgcttatatgataccgggaagctttaccaaattaacggaaatgccgctgtctgtgagcggaaaacttgatcgggccgcacttcctgagccgaaagaaaccgagagaaccggtgattatcaagctccgcgcacaatgcttgagactgagctgctgtctatttggcaagaagtgctgaaacgggaacacatcagtatgagagatgatttcttccaaatcggcggacagtcgctgaaagccgcgtcgcttgtttcaaacatacataaacggctgcaaattgaacttgccgtccgccatgtttttgaacatccgaccatcgagagcatggcccgcttccttgaacagaggaaaagaggagaatatgcagaaatcacgcctgctgtggcaaaggacttgtacccgctatcttttgcgcaaaaaaggctctatgcccttcatcagcttgcagcggacagtacgggctatcatatgcccgcttgtctggaactgagcggcagactcaaccgggatcgtctgcacgaagccttttcagcgctgttacaaaggcatgaagcgttacgcacttcatttgttttgcgaaacggggagccgatgcagcacatacatgcacatgtcgatcttgacctcacagagattcacatgccatccgggaaccttcttcaagaggtgatggaaactttcgtcaaaccgtttgacgtggaaaaagcgccgcttttgagagtgactttagccaaagttactgaagaacgtcattttctgctgcttgatatgcatcatcttatcgcagacggtgtgtcaatgagcgttctgattcaagaattgacggatttgtacagaggaaaagagttgcggccgttaaaactccagtacaaagatttttccgtctggcagcatgagcggtttgccgctgaagaattcaaaagacatgagcgttattggctggatgcgatcggggaaaacattcccgttcttgatctgccgctcgataaaaagcgccctcagcttcctgatttcagcgggtccgttgttcgaacgcgccttcaaaaggaaacggcggagaacttgcgccggctcatggatgagacgggttcgacactgtatatgattcttttggcaagctactccttgttcctttctaaattgggcgggcaggaagacattgtcgtcggttcacctgcggccggcagaagccgcgctgagcttgacggggtcatcggcatgtttgtaaataccgtggcaatgagaagcaggccgaaaggggataagacattccgcgcttatttagaagaggtgaaaatgctcgccctcggcgcggccgaacatcaggacttcccgtttgaagaacttgcccaaaagcttgatacacaccgggaagtcaatcgcaatccgctgtttgatgccatgctcgttttgcaaaacagtgataatttcgaagtgaaccttccgggcttatccgtttcttcacatgcagtgaagcatgacatttcaaaattcgacttgacgcttcatgccgaggaacggccggatggctcactggattttcattttgaatacagtaccgcgttgtttgaaaaagatacgatcgaacggtgggccggtcattttaaagagcttttaggacaaatcgcagcggattacgaacggaagctgtctgacattcatttgctgggcataaacgagcggcagatgcttcttcaagcggaaaatcaaacggcggagtatccgaggcatgaaacgattgtcagtttattcgaagcacaggcggaaaaaatgccggatcaaattgcagccgtcatgtctcatgagcgtctcacctaccgcgagctcaatgaaaaggcggatcgaatcgccgatatgctgtcggaaaacggcatccgctccggacagattgtcggatttatgaccgaacgatctccggatatgctgattgggattctcggtattttaaaagcgggaggagcttatctgccgattgatcctgactatccggacgagcggatttcatttatgctgactgacagcggcgcgcgtgttctgttgacgcaatcgggtcttgggatatccggaatggacgggctgccggttttatacatcgataagcctgaatccgtttcagcagacagaacgaaagaaataataacgcctgaacagccggcttacgtgatttacacatcgggcacaacaggaaaaccgaaaggcgttatgacggaacaccgcaatgtcatcagccttatcacacataaaggactgccgtttgatttcggctctgaagacgtctggacgctgttccattcctattgctttgatttttctgtctgggaaatattcggcgcgctcttatacggcggaaaggtagttatcgtgccgaaagacacagcccgtgatccgcatttgtaccggcagctgctgcaaagtgaaggcgtaacggtgctgaaccaaacgccgacggctttttccggactcattcatgaagaggccgggcatacggacaagctgaagcttcgatatgtcattttcggcggagaagcgcttcagcccggcatgctgaaaagctggaaagagaagtacccggagacggagcttgttaatatgtacggtattacggaaaccacggttcacgtcacatgcaaaaaactgaatatggatgatattgagagaaacaaaagcaatatcggcagaccgctggaaacccttcatgcttttgttatggacgcctatatgaatccgcagccgatcggaattcccggtgagctttatatcggcggggaaggcgtcgcgaggggatatgtaaacagggatgatttaaccgcctcccgtttcatcacgaatccgcacgtttccggcatgcggctctaccggacgggtgatatcgccaaaaggctctcaaatggcgagctggaatatgtcgggcggaaagatgcgcaagtaaaagtcagaggccacagaattgagctgggagaaattaaatcagcgctgcaagagctttcctccgtgaaagaggccgccgtgatcacacgtgctgatcagcacggtcagcactccatttacgcatacgcggtcttacacgggaacgaaaagataaaagaagcagagattcaggcctctctcagagcttttctgccggaatatatgattcccgcccgcttgatagcgcttgatgaactgcctttgacggcgaatgggaagctggacgagaaggcgctcccgcagcctgaattaaatgatagccttggaaatgatatcagcctgagaaatgaaactgaagaaatgatggctgacatttgggaagaactcttaggtgttgaaggcctcggtcccaatgctcatttcttccatctcggcggggattcgattaaagcgctgcaagtatgtgcgaggctgaaacagcagggctatgaaacgaccgtccgcgagctgttcgagcatcagacactgggagaagtatcgatgcggctccggaaagtccgccgcgtgattgatcaggctcccgtcacgggagacgttccgctgacgccgatccagcactggttcttgtcgcaatcattgccgcatgatcattttaatcagtcggttatgctccgcagtgcggacagaatcaatgaatctgctatgagaaaagcgttggcacagcttgcggttcatcatgacgcattacggatggtatgcggcacgcaaaacggatcggtgattcaatataacagagcggaaaagctttctgaagaagaactctttacgtttgaaacgcttgacgtgagagggaaagggtcattacaagaggagcacgccgcaattgaacaggcggccgcctgtattcaaacttccattcggctggagacgggtccgctcgtagctgtcggattatttcacgctaatgatggcgatcatctgctgctttccattcatcaccttgtcattgacggggtgtcatggcggattttatttgaagatctcaccgcatgctacaggcaggtgctcgaaggaaaagaaaccgcgcttccggcaaaaaccgattcctatcagacttacgcgaagcaaatctctgattatgctaaaagccgccggctgttacaggaagcagactactggtccgaaagagaaagagcggcggtcgaaccgcttccgaaagatgcccgcatctcttccaatcttctgaaagatacagatgtgatgaccgttacattgacgaaacaggagactgagcagctgttaacggaagcgaacagagcatacacaacagagacgggtgaattattgcttgccgcgttaagccttgcgctgaacagatggaccggaaacgagacattcaaaatcagcatggaaggccacggaagggaagagcacttggagcatcttgatatcagcagaacaatcggttggtttacgtcaatttatccggtattggttgatgcaagttttcaagatcaggctgatgacggcgagcggctcggctatcacattaagcggacaaaagacatgatgcgccgcattccgcataaaggagcgggatacggggtgctgaagtatataagcaaactctgggaagagactgaatccgattctcctgaaatcagttttaactatctagggcagtttgacagggagatccgttccagcggctttggtgtttctcccgtaaaagcgggaaatgaagtcagcccagactgggaacgtccgtacacacttgatatcagcggctccgtatcgtcggaatgtctcagcatgcatgtcgtgtacaaccgttttcagtatcaaaaagaaacgattgaagttttgacgggatattttcatgcctttctcaagcagatcatctcgcattgcacaggcaaagaggagcgtgaatggagcgccgctgatttcagtgacgaggagttaacgctggaagatctgagtgacattatgggagccgtcaacaaactatagaaaaggagtggcgcaatggggcagcaaccggaaatacaagatatatatcctttatcttttatgcaggagggcatgctttttcattctctgttggatcatgactcaagagcctacttcgaacaagcggtgtttacgatcaacggacagcttgaccgggaacgattccaaaaaagtatagatgctgtttttgaacgattcgatattttccgtacgacatttattcataagaatgtggcgaagccccgccaagtcgtgttgaaaaacaggccgagccgcgttcagtttcatgatatttctcatttggacgagaaggcacaagacaaatataccgaccggttcagaaaagaagataaagataaaggctttgatttgcaatcagaccctctcatgagagtctccattttgaaaaaagcgcctgaacgctatgtttgtatctggagccatcatcatatcgtcatggacggctggtgcttcgggattgtcatgaaggaatttctgatgatctatcaatctctgggagacgggcggctcccgtctctcgagcctgttcagccatatggtaagtatattaaatggctcatgaagcaggatcgtaaagaagccgagattttttggaaaacgagacttgccgatcttgagcaatcggcgtctcttccgaaaaaatccgcggaaccaaatggcgaacttgagcaggcggttttcaccatttctgaagagcagacaaatgagctgaagaacattgcggcaagggcgggagcaacgctgaatacagtgttccaggcactgtggggcatgttgctgcagcgtgtcagccgctgtgatgacgccgttttcggttctgtcgtttccggccggccgtcggatctcgcaggcgtggaaaaaatggtgggactgtttattaatacgattcccgtgcgggtgaaaagcggttcattttcttttctggagctcgtcaggcatttgcagcaggagacgctgcaagcagaagcgtacagctattatccgctgtatgacattcaagcgcaaagccctttgaagcaagcgctgtttgaccacattatcgtgtttgaaaatgtgccggcccagcgtgaaattgaaaatgtgagtcagtccggttcatttgattttgcggtagaagatttcacgatggaggaagtcacaaactacggatgcagcataaaggtgattccgggaaattctctttatatccgcttaaactttgataccggtatctacgacagcgtttttatgaagaatatcgaaacatttttacggcatatgatgaattcagtcatctccgatcctgaaatttgcgcctccgagatcgcattgcttgatgcgcgtgaagccagaagtatgctggatgcgtttaaccgtacagaaacggttgaaccgccggctccgacgcttcacggactgtttgcccgccgcgccgcgctttcgccgcatcgtccggcgctccgttttccgggcggtatgctgacgtacgccgagcttgaccagtacacagacagactcgctgtttggctccgccaaaaaggcgtccgcaaagaaagcatggtcggcgtgctcgctgaacgctcgccggagatggtggtttcagtgcttgccgtgttaaaagcgggcggcgcctacgtgccgcttgacccggagtatcctgaggacaggctgctctatatgctcgatgactgcggcgcttgtatcctgcttgcacagccggggttatccgtttccggtttttccggcgagacgcttgaagtgtctctttcttctctgacaggcgagacggagacaggggctgtctctgaagaagcggatagcgattcgctcgcttatatcatttatacgtccggttcgacgggaacaccgaagggagtggctgttgaacaccgtcaggccaccgcctttttatccggcatgcaagggcagttcccgttgacggaagaggatattatcgtgatgaaatcatccttttctttcgatgcttccatctggcaattgttttggtggacgatgtccggcgcctccgtgtatctgcttcctgccggctgggagaaagatcctgtgcggatgattgaagcgtttgcctcagaaaaggtgacgaccgcgcattttattccggcgatggtcaacagctttttagacgcgctggaaacagagcctgcggaaacaagaacacgcctcggcagaaccttgacacgcgtgtttgccggaggggaagctctttcaccgcttacggctgcccggtttgccgatcttctgccggagaccgtgctcattcacggctatgggccgacggaagcgacggttgatgcggcgttttacgtctgtgaccgaaaacgggacagcggacggacgcggcttccgatcggaaaacccgttcctggtgcccgtctgtatgtattagatagcggaggaaccatccagcctgcgggcgtggcaggagagctgtacatcgcggggacaggggtggcccggggctatctgaaccggtccgagctgacggaggagcgttttctcgatgatccgttttatccgggagagcgcatgtatcagacgggcgatatcgcacgctggacagaagacggcctagtcgaatggctcggacgttcagacggacaagtgaaagtccgcggctaccggattgaaccgggagaaatcgaagcggcgatccggcgcatcgacggcattcgtgaggcggcggtcaccgcccggaccgaacacggcgaaaccgcgctttacgcctatatcgaaggacgggaaagcgatgacgtgcgggcggagcttgcgacacgccttccggcctacatgatgccggctcagtttatagagatgagcgaatggccggtcacgccgagcggaaagcttgaccgccgcgcgctgccggctcccgacggagcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaagacatcttcgcccggccgacggtggaagagctcgcttcggtcattcaggacttggaggagagcccgtatgaagcgattcagcctgcgcaaaaacaggacacctacccggtgtcttcggcgcagaaacggatgtatgtgctccagcagcttgaagacggcggtgtcggctacaatatgccggctgtgctggaactgacgggcccgcttgaccgcatccggctggaggagacgttccgggagcttgtggagcggcatgagtcgctcagaacgtcctttgaaacggggcctgatggcgaaccggtgcagcgcatccatgacagcgtgccgtttcagctggatgaggccgagtcagctgacgcattcgtccggccgttttgtctggaggaagcgccgctcttccgtgcggccctcgtgaaagaatcggacgaacgtcatcttttattaacggatatgcatcatattatttctgacggtgtgtccgtcaacaccttgattaaagaattcggcgagctgtacgcaggccgttcgcttgcgccgatgcgccttcaatataaagactatgccgtctggcagcggtcatttcaggagaaagaagggtatcagaagcaggaagcctattggctgaagcggcttgaaggagagcttccggtgcttgagcttccggctgacaagccccgtccggctgtcagaagctttgcgggcggcagcgtatcgtgcacgcttgacgctgaaacggcatccggccttcaccgcatcgcccgggatcacggctccactttgtatatggtgcttctcgccgcgtacaatacgttactcgcgcgattgagcgggcaggaagacatcatcgtcggctcgccgattgccgggcgtccgcacaaagaccttgaaccgattctcggcatgttcgtcaacacgctcgccatcagaacggagccgaaaggaggcaaacggttcaccgattacttggcggaagtccgccaggccgcgcttgaagcgtatgagcatcaggactacccgtttgaagagctggtggagcggctcggcgtgcagcgggacacaagccgcaatccgctgtttgacgttatgtttgtgctccaaaatatggagcgtgaatccctggtgttaaataagctgcatttggctcaagctgcggatacaagtcataaaaccgcaaagtttgatgccacgctttacgcgtcagaagggtctgacggttccatcagctttgattttgaattcaatacagatatctatcaaaaacagacaattgaaaaatggctttcttattttacccgtattcttacaaaagtaattgaaaaccaagcgataccgcttggtgacattcacgtactggatgatgctgaaacaaatcgcgtcatttatcagtttaatcagacgaaaagcgattacccaagacacgaaaccatcagccgtttatttgagcgtcaggcaaaagaaacccccgatgcccgggcagttgtatatgatggacaaatcttgacataccgtgagctgaacgaacgggctaacagaatagcggcggctctccgatcaaatggcgtcggtccggaaagcgttgtcgcattattaaccggccgcacaacagagcttgcttccggaatcctcggaatattaaaagcggggggcgcctacttgcctatcggtgacgatgtgccgcgggaacgggctgaatggatgcttaaagactgtaaagctgatattcttctccaatctgataaacttgacggtctgccgctttcaggaaaacgtttattcatagaggatattcaaacaaaggccggattgagttcgggaaatcccgaaccgctcggaggacctgattcattggcctacatgatttatacgtccgggtcaacaggtgcgccaaaaggcgtcatgattgaacagcgaagcgtgatccgccttgtgaaaaacagcaattatattgattttacgccggaagatagactgttgtttacttcatcattaggatttgatgttacgacatttgaaatattcggtccgcttttaaacggcgcttctttatatgtaagtgaccaggaaacctatctcgactctgatgttctggaaacatttatacaacaaaacggcattacgacactgtggctgacatcgtctctgttcaaccatttatcagaacaaaatgaacacgtgttttccggattatcccgattgattatcggcggggaagcactgtccccgagccatgtaaaccgggttcggaatgcgctgccgcatctctcagtatggaatggatacggaccgactgaaaacacgacgttctcgacttgctttttgattgaacaatcatacgatcattcaatcccgatcgggcgccctgtcggaaattcaaccgcatatatcataaacagcaggggaacaccgcagccgatcggcgtcatcggcgaattgtgcacgggcggagacggtgtggcaagaggatatttcggccgccctgagctgacggaagaaaaatttgtccccaatccttttgttcccggagaacggatgtaccgcaccggagatttagcccgctggctgccggacggaacgatcgaatatgccgggcggatggatgatcaagtgaaaatccgcggttatcgggtcgagctgggagagattgaagcaacactgaggagcctggacggcgtgaaagaagctgtcgtgtcagtcagaaccgggcagtccggcaataaagaactgatcgcatatatgagtctgcaggcggacatggatacagaaaaagtgcgttcttcactgtctaagcaactgccgaattacatggttccggcctatatgatggaacttgagaagctgccgcttacgccgaacggtaaattggatcggaaaaatctgcccgaaccggagctcgcgcttcaaaccgcgtacacagctccccgcaatgagcttgaagaacagctttccgtgatctggcaggaagtgctcggcacaaaacaagtcgggattgaggactcattttttgaattgggcggcgactcaatcaaagcgctgcaagtttccgcacggctcggacgctatgggtggaaaatgacggcgagtgacttattccggcatccgtccattaaggagctcgcgcctcttatccggaaagcggaaagagttatcgatcagcggccggtggaaggaaacattccttggacacccgttcagcagtggtttttatcacagcggatggaaaacagaaatcatttcaatcagtccgtcatgatgttcagctctgacgcattgcataaacagccgctcaaagaagccttggagcatcttgtcattcatcatgatgcactccggatcaccgtcagtgcagaaaacgaaagtttcagacaaatcaatcacggtattcaaaaagatgaactgtacagcttggacatttgggatctgtctgagacagatacttgggaaagagaaatagaaactgaagtggctgcgctccaacagcggatggatattgaaaaaggcccgttattaaaagccggctggttcaaaacccggtccggggattatttattcatcaccgtacatcacctggcggttgacggagtgtcatggcgtattttgctggaggatttatctgccgcttacactcaagccgtaaaaggtcagccggtccagcttccgccaaagaccgattcgtttaagcaatacgctgaaaggctttcagaatacgcaaaaagcagcaagctgatgcgtgaagaagaatattggcgttttattgaagaagaaacagccgccgaacttccttatgaaaaaccgcagcatcagactggagccgacagcattcggcaaacggtaagctttacgcttacagaagaagaaacgtccgttttgcttcagcaggtcaaccgggcctaccataccgatacgcaagatattcttctgactgccgcagctttggctttacgggactggacagggggcggcagactgcgcatcgcgatggaagggcacgggagagagcacatcatgccggagctcgacatcagccgcaccgtaggctggtttacctccatgtatccggtgctcattgacttgaacacagcaggcgctgagcttggaacgtcggtaaaaacggtcaaagacacactcggaagaataccggataaaggaataggctacggcattttaaaatacatgacaccgcctgaacaaaaaacaatccgcttcagacaagcgcctgaaatcagctttaactatttagggcaattcaatgatacagaagatcagcacacgttcagtctgtccggtcttgcaagcgggcacgacatcacgccgacatggcagcgggaacaagcggtggaaatgagcgcgatggccgcacaaaacaaacttcacttcagtttgagctatccgccgagccgcttccgcaaagaaacgatggaacagctgctgcaaactttacagcaatatttgcgtgatattatggcgcactgcaccggcaaagaggaagcagaaaaaaccgttagtgattttagcagcaaaacgttaacatctgatgatttggacagcatagcgagttttgtcgaggaactgtagaaaaaggcgacggggagattataacatgacaaaaaagaatgcaattcaggatatttatccgctgtcttatatgcaggaaggaatgctttttcattccctcctgcaaaaggaatcacaggcttacgccgagcaggcctccttttcaataacggggaaggttgacacccgcgtgtttgaagagagcgttcatgcccttttcgaaagacatgatattttcagaacgatctttatcagccagaacgtgtcagtgccgcagcaggtcgtattaaaagagcggaacgtcagcatcattgaggaaaatctcaccaatttaaacaaggctgatcaaatcaagcatattgaagaagccaaacgaagagaccgtaagaaaggatttcatctgcaaaaagacatgctgatgcgggtgacgctgcttcaaaccggtgaatgtgaatatacgtgcatatggagtttccatcacatcattatggatggctggtgtctcggaatcgtgctgaaagagttcttccagatatacgcctcgcggctccgccggacaccgttaacgcttgagcccgctgtgccgtacgggacctacatcaagtggctgatggagcaagataaagaaaaagccgcttcgtactgggagcggtaccttgaaggctttgagcagcagactgttctgccgaagcagaaaaaagccggcgaaagcagacaagaggaagtgacgttttccttttcaaaagaggacacggctaagctgaaagagctggccgtaaaagaagaggtcacgctgagcaccattttccacacgctctggggcattttgcttcaggcgtataaccagacagaagatgcggtttttggttctgtcatttccggaaggccgtctgaaatcgaaggcatcgagcgaatgatcggcctgtttattaataccgtgcctgtccggatcagcggggcaaacatcccgtttcaaaagctgatcaaaaatgtgcaaaaggatgctttgaaaggacaggcatacagctatcatccgctttatgacatacaggcgaattcacaggtaaaacaaggcttaattgaccacattctcgtctttgagaattatccggttgaacaggagcttgatgtgctgaacagcaagggggacacgaaagacctttttcacatccatgatttcagcatggaagacgaaaccaattacagtttttatcttatggtggcgccgggtgacgaaattcatttgaaaatgagatacgattcaagcatgtatgaccgccaatttattgaaaatatcaaaggccatttggcgcatatcgtctcccaagttctcgacaaaccggacatcacgccggacaagcttgcaatcatcactccaggggaaaaagcgcagctgcttgcgccgatttctgaagagaccgaaaagcctgaatatgacacggttcatgcaatgtttgaacggcaggccgcaaaaacgccggatcaaatcgcgattcggtatgaaggcgagtcagtgacgtacaaagagctgaacgaatcggctaataagctggcccgcctgctgcaaaagcgcggattaaagcgggaggaaccggtaggcgtcatgctcggccgttccccttctttagcggcggctgttctcggtattttaaaagcgggcggcgcctttgtcccgatagatccgggcagtccaaaggagcgtatccgatatgtcattgaaaacagcggctgcgtccatgttgtaacagagcggcatcagtcagtccccgcggaacaaacgctgcaagttacatacatagaagacgccgggacggaagcggacggaagcaatgtgcaatccattaatacggcggacgacctcctttatatgatttatacatcgggaacgacagggaaaccgaagggtgtgctgctcgaacataaaaatatggccaacctgctttctcaccaattgacgaacacagacattgatttttgcacaaatgtgctgcagtacgcatctgtggcgtttgacgtctgctatcaggagttattttcagtactcttgagcggcggcaccctttgtatcgtgcccgaatcaatcaaacgagacgtttctcagctgttttcgtttattgatcagcacaacacggaagttgtgtttttcccgactgcgtttgtcaaaatgcttttcaatgaagaaggttatgcacagtcttttccccgctgtgtgaagcatgtcattacggccggggagcagctgaccgtttcgcgtttgttcaggcagacgctccgtttacacggtatgcatctgcataatcattacggcccgtcagaaactcatgtggtttcaacgtatacgatttctgcgggagatgacatacctgaacatccgccgatcgggaaaccgatccatcataacaaaatgtatattctcagcaaaaacagacagcttcagcctctcggaattgcgggagaattgtatatttccggggcgaatacaggaagaggctatgtgaacaatccggcgctgaccgaagagaaatttttgccggatccgttcagaacggacgccgtcatgtaccggaccggagatttggcaagactgcgtgcggacggccaaattgaatacatcggccggacagatgatcaagtgaagatcagagggtaccggattgaaccgaaggaaattgaaaccgtcctggcaaatcatcatgccgtgaaagaagctgctgttctgattcaaacgaatgagtcgggcgaaaatgaattatgcgcctactgcagcgtctcacaagcgactgatccttctcagttgcgaagagatttggcgaaagagctgcctgattatatgattccggtcaaatgggcttttgttgactcaattccgctcactgcgaacggaaaagtcgatcagcgggcccttccggaagcttcggcgtacgccgcaggccgtcaatatacagctccccggaatgtgacggagctgaagcttacccgcatatgggaagaagtgcttcaaagcggaccgatcggcgttcacgatcactttttcgagcttggcggccattcattaaaggcgacggcactcgttgcaaaaatagctaaagagtgcagtgtgcaaatcccgctgagcgatgtcttcagccatccgactgtagaagaactcgccaaaatcatcagtgaagcagaagagaacccgttcgcatccatagaaaagacagaaacgaaagaaacatatcctgtctcatccgcccaaaaacggatgtacgtccttcaccagcttgaaaatggcggtgtcagctataacattccagccgttttagaggtgaaggggccgtttgaccgagacaggatggaagccgtgttcaaggaactgatccggcggcatgaaccgctcagaacgtcctttgaagaaaaaaacggcctgcccgtgcagaggattcatgacgacgtgccatttgcatttacagaagaacaatcagccgaagcgtttatccggccgttcgatctcggcaaagcgccccttttccgggcgggatttgtccaaatagaaaaagaccggcatctgcttttagctgacatgcatcatattatttcagacggcgtatccgtcaatcttttgatacgtgaattcagtgagctgtatgctgagagaagtctgccgccgttacggattcaatacaaagattatgccgtctggcagcaatcatttatggcgggcgccgcatatcggaaacaagaggagtactggctgaaccggcttgccggtgagattcccgtgcttgaattgccggctgataagccgcgtcccccggtgcggagcttttccggagaccgggtgtcatttgtcatcaatgaaaaacatacagcacagttgaaaaagctggcgaaagaaaacaaatgcacactgtatatgacgctgctcggtgtgtacacggttctgttagcccgtttaagcggacaggaagatatgatcgtcgggtctccgattgcaggaaggcctcatgccgaccttgacgccgttctgggcatgtttgtcaatacgcttgctttcaggacgcgtcccgacggaagcatgacattcaaagaatatttaaaggaaattcgccaaacagcgcttgaggcttacgaacatcaggattacccgttagaagagctcgtcgataagctcggtgtgccgcgggacatgtcccgaaatccgctgtttgacacaacatttgcgctgcaaaatatggaacagcagaagcttagggcagccggacttgaactgcagccggcagacgtcagcctgccgatttctaaatttgacttatcgctgtacatctctgaaaacgccggtgaattatactgccagtttgaatacagcaccgatttgtttaagagaaaaacgattcaaaaatgggcgggattttttacgacacttgccgaaaacgccgcggctgatccgggcttggaattagacgatatttctgttttgacagaaaaagaagaagcgtctctgcttcaagatttcagccccttgcagaaaacagcgtttccgattcatcagtctcttcatgatctgctggaacagcaagcggaaaaaacgccggaccgtccggcaattttaactgatgacatttcgattacgtatcaggaactgaacgaaagggcaaacgagcttgcgcaccagctgatcaagcgcgggataaggctggaggataaaactgccattatgggccggcgttctcctgacatgatgatcggcatttacgctgtcttaaaagcaggcggtgcatatctgccaattgatccggattacccggaagagcggattcgctttttactgaaagacagcggcgtgaaattcttactggcagaaccagaacttttcgcaccagatctttttgagggagaaacgatctctctgaaaagcggacaaacagggaaccctgaagctgcggccaaccctaacgttccggtaaaccctgattcattggcttatatcatctatacatccggttctacgggacgcccaaaaggcgtgcaggttgaacatcggtcagccgtaaactttttatactcactgcaaacacgttatggattaagtgattctgacatcattttgcataaaacatcatactctttcgacgcttcgatttgggagctgttttggtggccgatcgcgggagcttctgttttcctccttccgcaaggcggcgagaaagaccctgaaatgatactgaacgcattggagaataaccgcataacggcggctcattttgtgccatccatgcttcatgctttcttggaatatataaattccagaaaacagccgatcaaaaaaacctgcttaaaaagggtttttgccggcggcgaacaactgggcccgcacctggtttcccgtttttatgaccttctgccgggaacggaattgacaaattcctacggtccgacggaagcgacagtagaagcggcgtactttgatttgccgcaaggaaaagaatttcacaatgttccgatcggcatttccgggcataacatgcggctttatattttaaatcaaaagaaacagcttctgccgccgggctgtatcggagagctgtacatcgcggggacaggggtggcccggggctatctgaaccggcccgagctgacggaggagcgttttctcgatgatccgttttatccgggagagcgcatgtatcagacgggcgatatcgcacgctggacagaagacggcctagtcgaatggctcggacgttcagacggacaagtgaaagtccgcggctaccggattgaaccgggagaaatcgaagcggcgatccggcgcatcgacggcattcgtgaggcggcggtcaccgcccggaccgaacacggcgaaaccgcgctttacgcctatatcgaaggacgggaaagcgatgacgtgcgggcggagcttgcgacacgccttccggcctacatgatgccggctcagtttatagagatgagcgaatggccggtcacgccgagcggaaagcttgaccgccgcgcgctgccggctcccgacggagcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaagacatcttcgcccggccgacggtggaagagctcgcttcggtcattcaggacttggaagagagcccgtatgaagcgattcagcctgcgcaaaaacaggacacctacccggtgtcttcggcgcagaaacggatgtatgtgctccagcagcttgaagacggcggtgtcggctacaatatgccggctgtgctggaactgacgggcccgcttgaccgcatccggctggaggagacgttccgggagcttgtggagcggcatgagtcgctcagaacgtcctttgaaacggggcctgatggcgaaccggtgcagcgcatccatgacagcgtgccgtttcagctggatgaggccgagtcagctgacgcattcgtccggccgttttgtctggaggaagcgccgctcttccgtgcggccctcgtgaaagaatcggacgaacgtcatcttttattaacggatatgcatcatattatttctgacggtgtgtccgtcaacaccttgattaaagaattcggcgagctgtacgcaggccgttcgcttgcgccgatgcgccttcaatataaagactatgccgtctggcagcggtcatttcaggagaaagaagggtaccagaagcaggaagcctattggctgaagcggcttgaaggagagcttccggtgcttgagcttccggctgacaagccccgtccggctgtcagaagctttgcgggcggcagcgtatcgtgcacgcttgacgctgaaacggcatccggccttcaccgcatcgcccgggatcacggctccactttgtatatggtgcttctcgccgcgtacaatacgttactcgcgagattgagcgggcaggaagacatcatcgtcggctcgccgattgccgggcgtccgcacaaagaccttgaaccgattctcggcatgttcgtcaacacgctcgccatcagaacggagccgaaaggaggcaaacggtttactgattatttggcggaagtccgccaggccgcgcttgaggcgtatgaacatcaggactatccgtttgaagagctagtggagcggctcggggtgcagcgggacacaagccgcaatccgctgtttgacgccatgcttgtcgtccagaatatagagcatgaggaactgctgttggacggtttgcatattcagaatgcggacgtgtcccgtccggtttccaaatttgatgtcactttgcaggcttctgaaggcgggggacagattcattttctgtttgaatatgcggcgtctttattccggaaagaaacgatgcagcgctgggcttcccactttatgacgatgcttgaacacattgtccgtgaaccggaaacttctttacaagcgatcagcatgctgactgctccggaacggaaccggattctttcagactttaacggcatgacggatcaacagctgcctgaaaaaacagttcatgaactgttcatcacccaggcgcgaaaaacacctgatgccgcggcccttatcagcggggaaacattgatcacatacaaagaattagatgactggtcgaataaaatcgccagagccctgcaaaaacggcagatcggacctgatgcagccgtcggcattgtgataccaagatcgccggaacaagtagcggcagtcttcggggtttggaaagccggaggagcttacgtcccgatagatcctgaatatccggaggaacgcaagcaatatatcatctcagacagcggcacagcgcttctccttaccgcacacggtgcgatagaacaagtgcctgatcgttttaacggtgaagtgctcgcactggaggatattcaagaacaggatgcttcgccggtccagtcattatcagcaccggaagatttggcttacatcatttatacatcgggaacgacaggcaggccgaaaggggttatggtcgaacatcgatccgtcagccaaacccttcaatggcggagcggattttatgatctgaatgagaaagatacgattcttcagctcttttcattttcatttgacgggtttgtaacaagcatgttcacaccgctgatttccggtgcgaaagcggccgttttagccgaagatgaagcaagagatattcttgctattaaacactatcttgcatcttaccgcatcactcacatgatcattgttcccgtactgtaccgtacactgcttgacgtactggagccgggggatgcagagtctctcagaattgtcacattagcgggagaagctgtcgaccaaaacattatcagccgcagtttatcagtttgtccacacactgagcttgccaatgagtacggcccgacggaaaacagcgtcgccactacagcggcaagacatatagaacaaagtaagaacatcacgatcggccgtccgattgagcattcacacgtttatattttaaacggagatcatccgcagccgatcggtgtaacgggagaactttgcatttcgggttccggccttgcaagagggtaccgcaatcttcctaagcaaacggcccaagcctttgtccaagacccgttccagaagaaccggcgcatgtaccgcacgggcgacctggcaaaatggctgccggacggcacgctgcagtatatcggccgaatggacgagcaagtcaaaatcagaggctaccgggtggaactgaaagaaattgaatccgccttaacaggcataaaaggagtcaaagaagcagccgtcaccgctctgcccgcatcagcaggccaaacggaactatgcgcttatatcgtgacagaagaaggaacagaaagtgaaactgtgcagcaagcactcagaaatgaaatgcccgcttatatggtgccggcgttctttgaaacacttgaagccctgcctgtcacaccgaacgggaagcttgaccgccgcgcgcttcctgagccgcggaaaaaagcgcacaccggacgggcatttaccgagcctgaaagcgacatggaaaaagagctgtccgcgatttggagcgaagtgctcggaactgaaaacattgccgcggatcaatcattttttgaactgggcggcgattccattaaagccctgcaagtatcagcccgattacatcaggcaggaaaacagatcgccgtaaaagatattttcagccggccgacaattagggagctggcgccttatgtccgtacagagcggcagccggtcagccaagctcctgcagaaggagaagtgaagtggtcgccgattcacaaatggttcttcacacaagacatgaaggaagcaaatcattttaaccagtccgtcatgctgacgagagcaaattcaatagatgaagaggctctgaggaaaacgttaaaagccattaccgttcatcatgatgccttgcgcattgtctgcaaaaaagacgaagagaaaggtcttctcctcttcaacagaccggctgacctcgcagatgagcagctttacagcctgaccatattagaaatggaaggcgatgagcatgagaaggaacgttttgtaaaacgccgcgtcgcagagcttcagagaaacatggatttagagaacgggccgctggtacaggcggggctgttccgctctgaagcagaagattacttgtttctgacggtccatcatctcgctgtcgacgggatatcatggcggattttattggaagacttggcttctgcttatgaacaggccgtctctggacaggaaatcaaactccctccgaaaaccatgtcattcaaaacatatacggagcagctggccgattatgccgaaagtaaacagcttcttcagcaggcggagtattggcgggagattgaacactatgaaacagaaagtcttccttacgaacaggcagatttatctcaaactcctgcaaaaaaacggaacacggtatccttcactctgacagaaagtgaaacggacgccctgttgaaagatgtgcacagtgcctacaatacggatacgcaagatgtgcttttggcttccgccgtgcttgccattcaaaagtggtcgccgcggcacgctttgaaaatcgcccttgaaggacacggacgccaatcagagcaggcaggtgcggacatcagcaggacagtggggtggttcacttccatttacccggtgcttttccggagcggagtttatgaacctcttgaagaatatgaaattcgcacattgaaatccgtcaaagacacattgcggcgcattccggataaagggaacggatacggcgtcctcaaatatttaacaccgccgaagcttgccgggatgactttcgggaaagcaccggagatcagctttaattatctcggacaattcgatgcgcccggcgggaacccggcagaaacggaacagcctgacgcgtttcagttttctcctttgggaggcggagatgatgtgacagatacatggaaacgggagcagtcacttgaaatcagcgcgattgcggcaaaaggccggatgaccgtcagcatttcctatgaaacggagcgcttccggcaagatacgatcgaacggctgtccgaaagctgccggtattatctcctgaaactgtcggaacactgcctcagcaaaaccgatacggagaagaccgtcagtgactttgatgatcgggagctgactgaggaagcattgcaggatattgccgacttactcagcttccactaaaccgagcgggaggaacacatggacaaaacaaaaaatatccaaaatatttatcccctcagccgaatgcaggaaggaatgctttttcattcctttctgcaaaaggagggggctgcatatatcgagcaatccgtcttcaccataaaaggccggcttcgtccggaattgtttgagcaaagcgtacagtctgtcatcagccgtcacgatattttcagaacggtttttttacctcatgtcgctcagctgaacggcccccgccaagttgtgctgcgtgagcgggaattccggctgcaccgcgaagatcttacacatttggacgaagcggaacagagcatctatttacaacgatttaaggaacgtgaccgcttaaaaggctttgacttgcaaaaggatatgctgatgcgcgtttctttgtttaaaacggctgacgaaaaatatgtatgcgtctggagtcaccatcacatccttatggacggctggtgcctcggcatcgtccttcaggaattcatgcatatgtaccgggcgattgaatcaggctcacctgtcacactggcacccgcaaagccttacagcacttatattacatggctgactgctcaggacaaagacgcggcttctgagtattggaaaggatatttagcaggctgcgagacaccctcaggactcccgaaaatatcggcccgtccccaggaaaaaggctaccgcaaggaagagctgctgttttctatagatcaaaacctgacggacaagctgaaaaccatcgccaaagaagagggcgctacgctcgcagttcttatgcagactgtatggggccttatgctgcagcgctacaaccggacggacgatgccgtattcggcgccgtcgtatcagggcggccttccgtcattgacggcgtggaaagcatgatcgggctgtttatcaataccgttccggtacgcattaaaacgggtgacgaaagctttagagaactgctgggccgcttgcagaaagaaatgcttgactcagaggcgttcagctatcatccgcttgctgacatccaatcgcagactgagctgaaacaggatttaatcgaccatattatcgtgtttgaaaattatccgattcagcagcagatgaaagacgcggaaaaggaatcggatgcaccattccggatcgggaatgtcaacgtttcggaacaatcgggctacgattttaacctcatcatagcgcctggcgatgagctgctcatcaaattcagctacaatgcgaacgtttatgacgaagtatggatagagagcgtaaaaggacacttggaagaagctctgcgcggcgccgccttcaatcccgatgttcccgctgatcggcttccgatgctcggacaaaaggaaaaatcaagaataatcggcgaatttaatgacacgaaaacaacttatgaaagagatgaaagcatcatcagcctgttcagccgacaggtgaagaaaaccccggaccatcaggcgcttcacgccggcgggctgacgatgacgtaccgggagctcgatgaacggtcaactgcattcgcccgcaccctgctggaaaacggtctggcgccaaagggaattgccgggattctggccgaacgctcaccggaatttatcatcgctgttctcgctgtattgaaagcgggagggacgtaccttcctcttgatgcagaactgccaaccgacaggatcgccgatatgctcactgagagcggagcacagctgttaacggtacaaaaaggaattgagactgacattgacttttctcacatcatctctatcccggctgcagctgaaaaacaaacacctgatgcgggaaaactgaataccgatacagcacctgatgaccttgcctatattatgtatacatccggttcaacaggaaaaccgaagggcgtgatgatttccaaccgaaacgtcgtatcgctcgtgtcaaacagcaattacacgtcggctggcatgtcggaccgtctcattctgacagggtccatcggttttgatgcagtgacgttcgaaatcttcggagcgcttttgaacggagcatgtcttcatgtggttgaccgctcgacaatgcttgcccctgagaggttcggcaattatctttcttccaaccgtattacgattctgtttttgacgacggcgctctttaaccagttcgcccaggcagatccggagatgttttctgggttgcacaccttatatgtcggcggagaagcattgtccccggcgctcatcaataaggtcagacaccgctgtccgaatctcagcctttataacatatacggaccgacagaaaatacgacattttctaccttttacgaaatcaggcacgatttttctcagccgatcccaatcggaaaaccgatcagcaattcaaccgcgtatatcattgataaaaatggcggacttgcgccgatcggcgtgcccggtgagctttgtgtcggcggtgacggggttgccaaaggctatttaaacaggcctgacttaacaagtgaagcgtttgtcagccacccggttcatcctgaagaaaagatctacaaaacaggcgacttggcacactggctgcctgatggaagcatcggatacatcagccgtatcgaccgccaattcaagattcgcgggaagcggattgagccggccgaaatcgaagcgcgcttgactgaaattgatggaatcagggaagcggcagtcatcgtgtcagacgaaggacaagaagcaatcctttgtgcgtattatacaggcgcacatgttgaagaaagagccattcgatccctgttggccaggtcgcttcccgactatatgattcctcagtatgtgatgaagcttgaccgtatgccgcttaccgcaaacggcaaagtggaccgccgcgggctgcctgcgccagaacggaaaaaaacgtcatcaaaagccgttccgccacgaaactgggtagagcgtgagctgatcgacatttggacgccgatcctcggctgcagggagatgggcatacaggatgacttctttgagctgggcggccattctttgaaagcattgcaagtgattcatcagctgaagaccaggcagcagatggatgtgccgattgaaatgatatttgaatatccgacaattgaacaattggctgaaaagctgtattcaaacacactgacagaagctgcagagcagcatatcagcagactgaaccagtcgaaaggccgcaatcttttctgttttccgcctatctcaggtttcggcattttctttaaagatcttgcggcggcattaaatggacgggctgctgtgtacggttttaactttattgaagaagacagcagaatggaacaatacattgataaaatgctggaaatccagccggaaggcccttatatactcttcggatattcggcaggcggcaatacggcattcgaggcggcaaaagcgatggaaaagcgcggcttagaaatcagcgacgtcattatcgcagacgcgtacagaaagcttgacacattgccgccgcagccaacaaacgcaacagccgaaaatgtcccggaagccgtcagggaagcggtcatccgaaaaacagagcgctatcaaacgtactgggcggaactgataaatgacggccaaatcgcggcaaacctccattttatcgaggccggcataaaggaagagcacagtgataagaccgagccgatgaaatgggaaggcgccacaacgggactctatcaggaatatcaaggcgggggcgcccataaagatatgtttgaacccgcctttgcacagcagaatgctgaggtcatactggacatcattgcaaacagcggaagacgcttggcgcggaatctgtaacatccggcagaatggttcagtatgacagagggcaagataggggaatcaaaccagtttttttggaggctttgacatgacgaacctatcttggcttacgtatgtaatgatcattcttgccagctaccggctgacccatttgatcgtatttgataagattacggaattcataagaaaaccctttataaagcaagaaaaaaccgtcgatcaaaacgggcgcgccgtccaaaaaaaagtcccttcctccgcattcggttatatgctgcaatgttattggtgtgcgggcgtctggtgcgccatattgatcggcatctgctacttggtctggccccgctatgcacatccggttattttcattttgtccatcgccggagcgcaggccattcttgaaacgtgtgtcggcgtcggaacgaaggtcattgacgtgctcgccgctatgaaacataaaaagtcctgaagcgttttgattcgctttaggacttttttctttcccttttaggctgagaggagcaaagcaggctttctgattcaccgcccggaatgcttcggaataccgtaaagcagagagggggaaaaacatgaaaagctgccgttttagcatgatatggtttttggccgttgtactgacagccggcatctttacattctcagcatccgcacaagcaagcggcactcagccggagagagaaatgagagccgtatggatcgcgtctgtcaccaatatcgactggccctctaaaaaagggctgtcaccggaagagcaaaaaagagaatacagcaagctgctggatgacgttcaggagatgggaatgaacgccgttatcgtccaaattaagcctgcggctgatgctttttatccatcagattacgggccttggtcagagtatctgacaggaacacaaggcaaaaatcccggctacgatccgcttgcttttttagttgaagagacacataaacggaatcttgaatttcacgcttggttcaatccttaccggatcacgatgaatcacacaaatttgaatgcgctttcagatgatcatcccgcgcgttcgcatccggactgggtcgctgcatacggaaaacagctgtactacaatccgggcattccggaagtaagacaatttataacggatggaatcaaagaggtggtcagccgttatgacattgatgcggttcatatggatgattatttttatccttataaaattgccggacaggaattccccgatcaggcggaatacgaacggtacggaaaagctcactttgcatcagttgatgactggcgcagggataacgtcaaccggcttgtaaaagaaatcaaccaaaccatcaaacgagaaaaaccttatgtcaaattcggaatcagcccgttcggcgtatggagaaatgccgcagatgacccgacaggctccgaaacggccgcaggggtgcggaactatgatgatttatatgctgatacgagagaatggatccaaaaaggatacattgattacatcgcaccgcaaatttactggagcatcggatttaaagcggcggcatatgacgtcttagcggattggtggggaaaagaagtgaacaatcggccggtgcatttatatatcgggcaggcagcttataaaatcaacaacaacgctgatccggcctgggccgacccgggggaatacggaaggcagattactctaaacaggggatcagcatggataaaaggcagcatgcatttcagtttaaaggatttaaaccgtaatccgctcgatgtaaaaaaccgtttgatcaaagacatgtacagccggcccgcattaattcccgagatgccttggctcggacattccgctttaaaaaaaccggctgtcaaacgggcggagaagaacgcttcaggccatacactctatatcgaagatgcgaaatccaacggtaaaaaaacggcttattacgccatttaccgcgcagaaaagggaaagcagccttatttagtggatacagtcagaaaaacatcgtcacggacgcagacattttcagatactgatattcgggcgaaagaagcctgcacctatttcgttacttccgttgacaggcttcaccatgagagccgtccctccgcaaaacggacaattaaatagccattattaataaaactgaccgttgcggcgctgtcagtttttttgcagcggatgagtccgaatgttcagactttatttggatggaatgaataaagacccccattaataaaatgtagaaagcagcagaaggaggaaggttaatgaattttcaactgacaaaagaacagcagatggtgcgcgaaatggtcagagatttcgccaaaaatgaaattgccccgaaagcccatgaggttgatcaatcggccgtcttcccgatagacacatttaaaaaaataggcgaactcgggctgctcggaattccgtttccggaagaatacggcggggcgggcggtgataccatttcatatgcagcagcggtcgaagaaatcggaaaagcctgcggcagcacggggctgagctacgcggcggccgtgtcactcggcgcaagcccattatactatttcggtactgaccaacaaaagcaagaacatcttattccgcttgcttcgggaaaagcgctcggatcattcgggctgacagagccgaatgccggttccgatgccggcggaacccagacaaaagccgagaaaaagggcgatgactatgtgataaacggagagaaatgctggatcacaaacgcaaattacgcccgcacggtcattgtcaccgccgttacgggaaagaactccgccggaaaaccgatcatttcagctctcatcgtcccgacagacacaccgggatttacgatcacaaatccgtacgacaagatgggtgtgagagggtcggatacggccgaacttgtgctggaggatgtcagggtgcctgccgataacctgctcggtgatcctgaaaaaggttttaaacaatttttatatacattagacggcgggcggatctcgattgcggcactggctgtcggtatcgctcaaggcgcactggaggcatcgctgtcatatgcgaaggaacgcaagcagttcggcagtccgatatcgtcatttcaagccattcaatttaagctggccgatatggcgatggaaattgaccttgccagacagatggtgcttaaagcggcatggctgaaggatcaaaacctgccatttacgaaagaagctgcattcgccaagctttatgcttcagaaatggccgtcagaacatgccttcaggccatccaaattcatggcggttccggttatatgaaggaatgcggtgtcgaacgtatgcttcgtgacgcaaagctgatggagattggcgaaggaacgtcagaaattcaaagaatggtcatcgcaagacagcttttgaagtgaaatgaaaacgtttactaagacagggatggaagggggcaggtcatatggctgaacttatccatttaacagccggaaagctgcttgagcggaccgcggagctttttccggatcgtgaagcggttgtttaccctgagcgcggccttcgttatacgtatgccgagtttgaccggttatgccggcaaaccgcaaaagggctgatgaagctgggagttgaaaaaggagatcatgttgccatatgggcatccaacattccggaatggctcgcggcgcaatttgcaacggcgaaaatcggcgccgttctggtcaccattaataccaattttcaaatcgcagagctcgattatctgctggcacattcagacgtctcggccttgataatcatggattcctaccggcagacatcttatgttgagatggtgaataagctaattccggagctgaaaacttgtgagcgcggcaggctgcgttcgaaacgttatccctttttaaggacggtgttatatatcggtgataaaagcctgcccgggatgcaccgttgggattcattgctggataatgccgaagctgtaacggatgcagcgcttgacggaaggatggacagcctgaaaaaggatgattgcattcatatgcaatatacatcaggtacgaccggatttccgaaaggcgtcatgctctcacattttaatatcgtaaataacgcggccaatatcgcagaatgcatgaagcttacttcatgtgaccgtttatgtattcccgtgccgtttttccactgctttgggtgcgtgctcggcgtgctggcatgtgtttccgcgggtgcggcgatgattccgatcgaacagttttctccgccggccgttctgaaaacggtggagcaagaagcctgcacggctctgcacggtgtaccgacgatgtttatcgccctcctaaatgacagccgtttttctgaatatgatctttcccacgtccgaaccgggattatggcaggctcgccatgcccggcggaagtcatgagagaagtgatcggcaaaatggggatgactgacattacaattgcctacggacagaccgaagcatcacctgtcattacgcagacaagaacagatgatccgtttgaaagaagagtggaaacagcggggcgcgcgcttccccatatcgaagtcagaatcgttcggcccggaacatccggagaagccgccaggggcgaacaaggagagctctgcacccgcggatatcatgtcatgaaaggctattataaaaatcaagaagcgaccgaagaagcgatagacaaagacggctggctgcataccggtgatttggcggtcatggacgaggacggatactgcaaaatcacgggccgtctgaaagacatgctgatcaggggcggcgaaaatatctatccgcgcgagattgaggaaatgttatatcggcatcccgcagtggcggacgttcaggtcgtcggcgttcctgatccgaaatacggagaagaggccgcggcgtggatcaggctcaaagacggacaaaccgcttccgcagaagacatcagaaccttttgcaaagaacatatcgcccgctataaagtccccaggtatgttttgtttacagatgaatatccaatgacagcctcaggaaaaattcagaaattcaagctgcgggaaaaaacgattgaagagctcaagttaacttaatgaaaaaggagtgcttcacatttgtttaaaaaagtcctgattgccaacagaggagaaatcgccttacgaattatccgcacctgcaaacgtctcggcatcccctcggcagctgtgtattcagaagccgaccgggacgcgctgcatgtaaaagcggctgatgaggcctatccgatcggtaaatcgagagtaaatgaaagctatttacatatcgacagaatcatagaagccgccaaatccgccggagcggacgccattcatccgggctacgggcttctgtcagaaaacagcctgttcgccgaacgctgccggaaggaacaaatcacatttatcggtccgcccggtgatatcatcgccaagatgggcagcaagattgaagcccgaaaaacgatgcaaaaagcaaaggtcccgatcgttcccggtgtttcagagccattgcccgatgttcactccgccttagccgaagcccgtgccatcggttttccggtcatgctgaaagcgtccgcaggaggaggcggaatcggcatgcagatcgtacattcagaagaagagctggccaaagcgttcgaaggaaatcaaaagcgggccgcgtccttttttggagacggcgcaatgtacatggaaaaggtcattgaaaatgcccgtcatattgaaattcagatactcgcagattctttcggcaacaccgttcatctgtttgaacgtgactgttcagtccaaaggcgccaccaaaaagtgatagaagaagcgccgtcgccgtttgttgacgatgaattaagacaaagactcggtgaaaccgccgttaaagccgcaaaatcgatcggctaccaaaatgcaggcacaatagaatttctcgtcgaccaaaagaaacaaatctattttttagagatgaacaccagactgcaggtggagcatccggtgacagaagaaattacaggactggatcttgtggaagaacagctgaaaattgccgctgggcaggcgctgcctttctcgcagaaagatatcaaccactgcggtcatgcgatagaagtgcggatttatgcggaagatccggtcaccttttacccgtctcccggtaccatctcgtctttttccgttttaagacacccgtcagtgcgacacgaatgcgccgtcgaaaagggaagcgtcatttctccgttttacgatccgatgattgccaaaatggtcgtcacggcgaatacgagaaaacaagccattgaacaactgaaaaccgcccttggcgaatatcatgtagaagggattaaaaccaacattccgctgctgacaaaaatttcccattcagaagggtttgaaaagggcgaggcaacaaccggttttttacaaacaatgaacgagggggcgtcaaaatgagcgtcataaaaattcaaatggcgggaaacctgtggaaaattcatgtgaagccgggtgatgtcattgaagaaggacaggaagtggccatcttggaatctatgaaaatggaaattccgattatcgctgatgcagcgggtacggtgaaagaagtgaaaaaatcagaaggtgatttcactgatgaaggagaggtcctgattgaacttcaataaaacgggaggtgcagcatgaactgtccgaaacatgtccgcatcaatgaagtaggaccgcgtgacggcttgcagaatgaatcggcgtgggtggatacagaagataagattgagtggatcaatatgctgtcaaaaacaggtcttccctatatcgaagtgacatcattcgtgcatccgagatggattccggctcttcgtgacagcctggacgtcgcaaaaggcattgccagatctgaacatacggtctacgcggctctcgttccgaacctcatcggactggagcatgcggcagaaggcggaatcgatcaggcatgtgtatttttatctgcaagcgaaacccataaccaaaaaaacgtaaacaaaccgattgaccggaccgttcaagagctcaggcgggttattactgaagcaaaagctgaaaaaatggcgacgagagcttatctgtccactgtgttcggctgtccgtacgaacagaacgtgccggtagaacaagtcatccgcctgtcagacaccctgctcgaaatgggtgttgatgaaatatcgctcggcgacacgatcggcgcggcaaaccccttgcaggtcatagccgtgcttgaagcccttttgccgagaattcccgcctcaaaaattgcactccatttccatgatacaagaggaacggctctagcgaatatcattcccgctcttgatatgggcatcacatcctttgatacttcctcaggcgggcttggcggctgcccgtacgcccctggatcagcaggaaacgctgccacagaagacgtcatttatatgctcgaacaaatggggattgataccgggacggacatgaataaacttctttatgccgccggctggatcgcggataaaataggcaaagacctgccaagcagaaacctgcaggcattcagaacgaaatgagaaaggagaagccatgggagattgcgtcttgtattccgtctgtcaagaaacgatcggtctgatcacgctgaaccgcccgcatgcggccaactcgctgtcttcagacatgattgatcatttacagcgtgtgattgaagacatcaaaaactcgccatccattcgttgtgtcattctcaccggcactgggaacacattttgcgccggtgctgatttaaaagaaagagcggggatgaatcatgaacaagttaagcaaagcgtcaggcgtatcggtgaaacggccgcatccattgaagctctcccgcagccggtcattgcagcgctgaacggaaccgctgtcggaggaggccttgaactcgccctcgcctgtgatatcagaatcgccgtcagccgggcgggcctcggccttcctgaaacagggcttgcgatcattcccggagcgggcggaacgcagagactgccccggcttatcggccccggcgcggcaaaagaattgatctataccggccgaaggctttctgccgaagagggaaaagacatgaagctgatcgagcatgtttgtgaagccggtgaacttatggaaaaagcaaaagcactggccggccgcatcgccgctaatgggccgatcgccgtcagacaagcaaaatccgcgataaacaagggtctggagacagatctcaatacaggactcgaaatcgaacgaaaagcatatgaacaagtcatccccacacttgacagagaagagggcctgcgcgcttttaaagaaaaaagaccccctgaatacaaaggaaaataaaacatggagggactcggatggattacgaaaaagaacggcagacacgcagcaaaacgattgaaaagggaggagccgcgaaatatcacgcaagcaacgaaaagaagggaaaactttttgtaagagacaggctgaagcttttattcgatgacggcatatccgttgaagacgcttttttcgccgagtgcatgtcagacggactgccggctgacggggtcgttaccgggatcggaaccatcggcggcagaaccgtttgtgtgatggcaaacgactcaaccgtaaaggcgggctcgtggggcgcgaaaacggtggaaaaaatcatccgcattcaggagacggcggaaaagcttcagtgtccgctcttgtacttagtcgattccgcaggtgcgagaattacggatcaggtcgacatgttcccgggcagaaggggagccggccgcatcttttataatcaagtaaagctgtcgggccgcattccgcaaatctgtttattgttcggcccttccgctgcgggcggcgcttacattccggccttttgcgacattgtcattatggttgagggcaatgcatccatgtacttaggttccccgcgtatggcagaaatggtgattggcgagaaagtatcgcttgaagaaatgggcggcgcccgtatgcattgttccgtatcaggctgcggtgatctcctcgcccggacggaacaggaagcaatcatgatggcgcagacatatctcagctactttccggcaaattatactgaaaaagcgcccgtcaacaaatctaagaacccgaaagcttttgaaaaaccgctctcagatgtcatcccggcacatcaaaacgcaccgttcaacatgatggatttaattgaacgtgtcattgatgaagactcattttttgagattaaaccgttatttgcgcaggaattaataacggggcttgcgcggattcacggacagccggtcggcattatcgccaatcagccgcgtgtcaaaggcggggttttatttctcgattcggcggataaagccgcaaaatttatcgctttgtgcgacgcattccatattccgcttctgtttttagcagacattcccggattcatgatcggaacgaaggttgagcaggcgggcatcatcaggcatggcgcaaaaatgatctccgcaatggcggaagcgactgttccgaagctttccgttatcgtcagaaaagcctacggtgccggattatacgcgatggcggggcctgcttttgaaccggactgctgtttagcgcttccgactgcgcaaattgccgtaatgggtcctgaagcagcggtgaatgcggtctacgcaaacaaaatcagcgagctagcccctgaagaaaggccggcttttattcaagaaaagcgtgatgaatataaggaagacattaacctttaccggcttgcttctgaaatggtgattgacggcattgttcctgctgattccttgcgggaagaactcaataaacgcctcactgcttacatgtccaaacaactgacattcacacaccggaaacaccccgtatacccggtataaataaaaaaaagactgcatagatccggctcgcagccgttcttatgcagtcttttttcatagtcttgatctcattttcttcacaacaaaataaacaacaataaatacgagagccaatataatgatcggagttgtatacattccggcatagctgtctacgtctttccactgtcccccgagctgatacccgagataaacgaaaatgacagaccacggaataatggcgagcgtcgtcaatatgacaaacttggaaagaggcattttcgcaaggccggccgggatggagatcgcatgtctgacgaccgggataaaccgcgccgagaacacaacgccggcgccgtaacggcgaaaccagttttccgcaacatcaacatgatgctttttcagaagtaagtacttgccgtacttgtccaaaaacggccgtcccccataacgggcgatccagtaaataaagcactgcgcgatcgttcccccgatcacaccggcgacaatggcgccgataaagctgatcgtgccttctgacaccatatagcctccgtaagccagaacgatttcactcggaatgat
